US012466890B1

(12) United States Patent
Zhu et al.

(10) Patent No.: US 12,466,890 B1
(45) Date of Patent: Nov. 11, 2025

(54) TL1A BINDING PROTEINS AND METHODS OF USE

(71) Applicant: Paragon Therapeutics, Inc., Waltham, MA (US)

(72) Inventors: Eric Franklin Zhu, Cambridge, MA (US); Hussam Hisham Shaheen, Auburn, NH (US); Daniel Rios, Boston, MA (US)

(73) Assignee: Paragon Therapeutics, Inc., Waltham, MA (US)

( * ) Notice: Subject to any disclaimer, the term of this patent is extended or adjusted under 35 U.S.C. 154(b) by 0 days.

(21) Appl. No.: 19/005,529

(22) Filed: Dec. 30, 2024

Related U.S. Application Data

(63) Continuation of application No. PCT/US2024/041774, filed on Aug. 9, 2024.

(60) Provisional application No. 63/559,060, filed on Feb. 28, 2024, provisional application No. 63/559,071, filed on Feb. 28, 2024, provisional application No. 63/554,916, filed on Feb. 16, 2024, provisional application No. 63/554,897, filed on Feb. 16, 2024, provisional application No. 63/604,104, filed on Nov. 29, 2023, provisional application No. 63/599,923, filed on Nov. 16, 2023, provisional application No. 63/592,535, filed on Oct. 23, 2023, provisional application No. 63/519,056, filed on Aug. 11, 2023.

(51) Int. Cl.
*C07K 16/28* (2006.01)
*A61K 39/00* (2006.01)

(52) U.S. Cl.
CPC .... *C07K 16/2875* (2013.01); *A61K 2039/505* (2013.01); *C07K 2317/76* (2013.01); *C07K 2317/92* (2013.01); *C07K 2317/94* (2013.01)

(58) Field of Classification Search
None
See application file for complete search history.

(56) References Cited

U.S. PATENT DOCUMENTS

| | | | |
|---|---|---|---|
| 6,737,056 | B1 | 5/2004 | Presta |
| 7,597,886 | B2 | 10/2009 | Yu et al. |
| 7,612,181 | B2 | 11/2009 | Wu et al. |
| 7,820,798 | B2 | 10/2010 | Yu et al. |
| 8,105,589 | B2 | 1/2012 | Yu et al. |
| 8,258,268 | B2 | 9/2012 | Wu et al. |
| 8,263,743 | B2 | 9/2012 | Smith et al. |
| 8,642,741 | B2 | 2/2014 | Classon et al. |
| 8,728,482 | B2 | 5/2014 | Smith et al. |
| 9,068,003 | B2 | 6/2015 | Siegel et al. |
| 9,290,576 | B2 | 3/2016 | Attinger et al. |
| 9,416,185 | B2 | 8/2016 | Smith et al. |
| 9,556,277 | B2 | 1/2017 | Classon et al. |
| 9,683,998 | B2 | 6/2017 | Arch et al. |
| 9,737,612 | B2 | 8/2017 | Anderson et al. |
| 9,896,511 | B2 | 2/2018 | Siegel et al. |
| 10,138,296 | B2 | 11/2018 | Poulton et al. |
| 10,149,462 | B2 | 12/2018 | Lee et al. |
| 10,221,251 | B2 | 3/2019 | Humphreys et al. |
| 10,308,703 | B2 | 6/2019 | Aharoni et al. |
| 10,316,083 | B2 | 6/2019 | Michelsen et al. |
| 10,322,174 | B2 | 6/2019 | Bilsborough et al. |
| 10,590,201 | B2 | 3/2020 | Siegel et al. |
| 10,626,180 | B2 | 4/2020 | McGovern et al. |
| 10,633,449 | B2 | 4/2020 | Shih et al. |
| 10,683,338 | B2 | 6/2020 | Gieffers et al. |
| 10,689,439 | B2 | 6/2020 | Watkins et al. |
| 10,822,422 | B2 | 11/2020 | Poulton et al. |
| 10,829,566 | B2 | 11/2020 | Rapecki |
| 10,968,279 | B2 | 4/2021 | Pashine et al. |
| 11,059,911 | B2 | 7/2021 | Humphreys et al. |
| 11,104,745 | B2 | 8/2021 | Hsu et al. |
| 11,136,386 | B2 | 10/2021 | Kruidenier et al. |
| 11,186,872 | B2 | 11/2021 | Gonsky et al. |
| 11,220,549 | B2 | 1/2022 | Poulton et al. |
| 11,292,848 | B2 | 4/2022 | Watkins et al. |
| 11,312,768 | B2 | 4/2022 | Michelson et al. |
| 11,434,296 | B2 | 9/2022 | Shih et al. |
| 11,440,954 | B2 | 9/2022 | Watkins et al. |
| 11,474,112 | B2 | 10/2022 | Arch et al. |
| 11,767,364 | B2 * | 9/2023 | Pashine ................ C07K 16/241 530/387.9 |
| 11,820,793 | B2 | 11/2023 | Igawa et al. |
| 11,999,789 | B2 | 6/2024 | Watkins et al. |
| 2002/0111325 | A1 | 8/2002 | Li et al. |
| 2003/0129189 | A1 | 7/2003 | Yu et al. |
| 2003/0198640 | A1 | 10/2003 | Yu et al. |
| 2004/0038349 | A1 | 2/2004 | Hilbert et al. |
| 2005/0163747 | A1 | 7/2005 | Hilbert et al. |
| 2005/0214305 | A1 | 9/2005 | Li et al. |
| 2007/0010658 | A1 | 1/2007 | Holtet et al. |

(Continued)

FOREIGN PATENT DOCUMENTS

| | | | |
|---|---|---|---|
| EP | 1042343 | B1 | 1/2008 |
| EP | 1487854 | B1 | 4/2010 |

(Continued)

OTHER PUBLICATIONS

Edwards et al., J. Mol. Biol. (2003) 334, 103-118.*
Iwahashi et al., Moleculer Immunology, 36: 1079-1091, 1999.*
Aiba et al., "The Role of TL1A and DR3 in Autoimmune and Inflammatory Diseases", Mediators of Inflammation, vol. 2013, Article ID 258164, 9 pages.
Aliprantis et al., "A Phase 1 Randomized, Double-Blind, Placebo-Controlled Trial to Assess the Safety, Tolerability, and Pharmacokinetics of a Respiratory Syncytial Virus Neutralizing Monoclonal Antibody MK-1654 in Healthy Adults", Clinical Pharmacology in Drug Development, vol. 10, No. 5, pp. 556-566, 2021.

(Continued)

*Primary Examiner* — Marianne P Allen
(74) *Attorney, Agent, or Firm* — Greenberg Traurig LLP; Prashant Girinath; Natalie Salem

(57) ABSTRACT

Provided herein are TL1A binding proteins (e.g., antibodies that bind TL1A) and methods of use.

11 Claims, 26 Drawing Sheets

Specification includes a Sequence Listing.

(56) References Cited

U.S. PATENT DOCUMENTS

| | | | |
|---|---|---|---|
| 2007/0128184 A1 | 6/2007 | Podack et al. | |
| 2008/0003221 A1 | 1/2008 | Podack | |
| 2009/0269345 A1 | 10/2009 | Fan et al. | |
| 2009/0317388 A1 | 12/2009 | Burkly et al. | |
| 2011/0110852 A1 | 5/2011 | Miller et al. | |
| 2011/0129458 A1 | 6/2011 | Dolk et al. | |
| 2011/0195048 A1 | 8/2011 | Podack | |
| 2011/0217310 A1 | 9/2011 | Siegel et al. | |
| 2012/0195900 A1 | 8/2012 | Ghayur et al. | |
| 2012/0201746 A1 | 8/2012 | Liu et al. | |
| 2012/0328559 A1 | 12/2012 | Podack et al. | |
| 2013/0004416 A1 | 1/2013 | Wu et al. | |
| 2014/0255302 A1 | 9/2014 | Poulton et al. | |
| 2015/0004167 A1 | 1/2015 | Wu et al. | |
| 2015/0056182 A1 | 2/2015 | Igawa et al. | |
| 2016/0096885 A1 | 4/2016 | Shih et al. | |
| 2016/0208329 A1 | 7/2016 | Targan et al. | |
| 2017/0096491 A1 | 4/2017 | Classon et al. | |
| 2017/0166967 A1 | 6/2017 | Rotter et al. | |
| 2017/0190781 A1 | 7/2017 | Mills et al. | |
| 2017/0218091 A1 | 8/2017 | Ambrosi | |
| 2018/0052175 A1 | 2/2018 | Arch et al. | |
| 2018/0086840 A1 | 3/2018 | Attinger et al. | |
| 2018/0156781 A1 | 6/2018 | Shih et al. | |
| 2018/0230543 A1 | 8/2018 | McGovern | |
| 2018/0256747 A1 | 9/2018 | Hawthorne et al. | |
| 2018/0319889 A1 | 11/2018 | Croft et al. | |
| 2019/0106486 A1 | 4/2019 | Poulton et al. | |
| 2019/0135928 A1* | 5/2019 | Pashine | A61P 37/00 |
| 2019/0211400 A1 | 7/2019 | Rotter et al. | |
| 2019/0247498 A1 | 8/2019 | Bilsborough et al. | |
| 2020/0079863 A1 | 3/2020 | Attinger et al. | |
| 2020/0181258 A1 | 6/2020 | Leger et al. | |
| 2020/0362025 A1 | 11/2020 | Kruidenier et al. | |
| 2020/0392227 A1 | 12/2020 | Wang | |
| 2021/0070871 A1 | 3/2021 | Watkins et al. | |
| 2021/0079473 A1 | 3/2021 | McGovern et al. | |
| 2021/0093718 A1 | 4/2021 | Bilsborough et al. | |
| 2021/0122816 A1 | 4/2021 | Lee et al. | |
| 2021/0122828 A1 | 4/2021 | Watkins et al. | |
| 2021/0238684 A1 | 8/2021 | Bilsborough et al. | |
| 2021/0301015 A1 | 9/2021 | Tseng | |
| 2021/0347904 A1 | 11/2021 | Poulton et al. | |
| 2021/0371931 A1 | 12/2021 | McGovern | |
| 2021/0395824 A1 | 12/2021 | Gonsky et al. | |
| 2022/0002411 A1 | 1/2022 | Chen et al. | |
| 2022/0152085 A1 | 5/2022 | Dong et al. | |
| 2022/0185902 A1 | 6/2022 | Poulton et al. | |
| 2022/0213226 A1 | 7/2022 | Hsu et al. | |
| 2022/0259320 A1 | 8/2022 | Watkins et al. | |
| 2022/0290241 A1 | 9/2022 | McGovern et al. | |
| 2022/0306735 A1 | 9/2022 | Dekosky et al. | |
| 2022/0340642 A1 | 10/2022 | Kanai et al. | |
| 2022/0363745 A1 | 11/2022 | Michelsen et al. | |
| 2022/0390463 A1 | 12/2022 | Arch et al. | |
| 2023/0018729 A1 | 1/2023 | Kruidenier et al. | |
| 2023/0020356 A1 | 1/2023 | Gonsky et al. | |
| 2023/0060770 A1 | 3/2023 | Wang et al. | |
| 2023/0091596 A1 | 3/2023 | Shih et al. | |
| 2023/0157264 A1 | 5/2023 | Lee et al. | |
| 2023/0159649 A1 | 5/2023 | Croft et al. | |
| 2023/0192835 A1 | 6/2023 | Watkins et al. | |
| 2023/0235070 A1 | 7/2023 | Baniecki et al. | |
| 2023/0272061 A1 | 8/2023 | Kruidenier et al. | |
| 2023/0272098 A1 | 8/2023 | Kruidenier et al. | |
| 2023/0287499 A1 | 9/2023 | Gonsky et al. | |
| 2023/0304095 A1 | 9/2023 | McGovern et al. | |
| 2023/0366028 A1 | 11/2023 | McGovern et al. | |
| 2023/0381308 A1 | 11/2023 | Bilsborough et al. | |
| 2024/0034799 A1 | 2/2024 | Gonsky et al. | |
| 2024/0059799 A1 | 2/2024 | Apgar et al. | |
| 2024/0141053 A1 | 5/2024 | Poulton et al. | |
| 2024/0209103 A1 | 6/2024 | Potdar et al. | |
| 2024/0254238 A1 | 8/2024 | Rohlff | |
| 2024/0269319 A1 | 8/2024 | Hawthorne et al. | |
| 2024/0309104 A1 | 9/2024 | Luo et al. | |
| 2024/0327532 A1 | 10/2024 | Watkins et al. | |
| 2024/0336691 A1 | 10/2024 | Luo et al. | |
| 2024/0368263 A1 | 11/2024 | Watkins et al. | |

FOREIGN PATENT DOCUMENTS

| | | | |
|---|---|---|---|
| EP | 1558640 | B1 | 4/2011 |
| EP | 2546268 | A1 | 1/2013 |
| EP | 1667730 | B1 | 6/2013 |
| EP | 2353615 | B1 | 11/2014 |
| EP | 2638069 | B1 | 1/2018 |
| EP | 2941302 | B1 | 8/2018 |
| EP | 2978440 | B1 | 10/2019 |
| EP | 3350223 | B1 | 6/2020 |
| EP | 3402494 | B1 | 4/2021 |
| EP | 3613766 | B1 | 8/2023 |
| EP | 3639841 | B1 | 9/2023 |
| EP | 3774897 | B1 | 9/2023 |
| EP | 3458466 | B1 | 8/2024 |
| WO | 2014028776 | A1 | 2/2014 |
| WO | 2018154584 | A1 | 8/2018 |
| WO | 2019209995 | A2 | 10/2019 |
| WO | 2021247770 | A1 | 12/2021 |
| WO | 2022103961 | A1 | 5/2022 |
| WO | 2022140283 | A1 | 5/2022 |
| WO | 2022119842 | A1 | 6/2022 |
| WO | 2022178158 | A1 | 8/2022 |
| WO | 2022178159 | A1 | 8/2022 |
| WO | 2022232253 | A1 | 11/2022 |
| WO | 2023009545 | A1 | 2/2023 |
| WO | 2023046047 | A1 | 3/2023 |
| WO | 2023047375 | A9 | 3/2023 |
| WO | 2023102051 | A1 | 6/2023 |
| WO | 2023102071 | A1 | 6/2023 |
| WO | 2023133538 | A1 | 7/2023 |
| WO | 2023141611 | A2 | 7/2023 |
| WO | 2023220663 | A1 | 11/2023 |
| WO | 2024026386 | A1 | 2/2024 |
| WO | 2024026395 | A1 | 2/2024 |
| WO | 2024067451 | A1 | 4/2024 |
| WO | 2024078479 | A1 | 4/2024 |
| WO | 2024112618 | A2 | 5/2024 |
| WO | 2024118630 | A2 | 6/2024 |
| WO | 2024137353 | A1 | 6/2024 |
| WO | 2024148218 | A2 | 7/2024 |
| WO | 2024148222 | A1 | 7/2024 |
| WO | 2024173838 | A2 | 8/2024 |
| WO | 2024173861 | A2 | 8/2024 |
| WO | 2024173865 | A2 | 8/2024 |
| WO | 2024173877 | A1 | 8/2024 |
| WO | 2024186859 | A2 | 9/2024 |

OTHER PUBLICATIONS

Bamias et al., "Differential Expression of the TL1A/DcR3 System of TNF/TNFR-Like Proteins in Large vs. Small Intestinal Crohn's Disease", Digestive and Liver Disease, vol. 44, pp. 30-36, 2012.

Bamias et al., "Expression, Localization, and Functional Activity of TL1A, a Novel Th1-Polarizing Cytokine in Inflammatory Bowel Disease", The Journal of Immunology, vol. 171, No. 9, pp. 4868-4874, Nov. 1, 2003.

Bamias et al., "High Intestinal and Systemic Levels of Decoy Receptor 3 (DcR3) and its Ligand TL1A in Active Ulcerative Colitis", Clinical Immunology, vol. 137, Issue 2, Nov. 2010, pp. 242-249.

Cavallini et al., "The TNF-Family Cytokine TL1A Inhibits Proliferation of Human Activated B Cells", PLOS One, vol. 8, Iss. 4, e60136, pp. 1-11, Apr. 2013.

Collins et al., "CCL3 and MMP-9 are Induced by TL1A During Death Receptor 3 (TNFRSF25)-Dependent Osteoclast Function and Systemic Bone Loss", Bone, vol. 97, pp. 94-104, Apr. 1, 2017.

Dall'Acqua et al., "Properties of Human IgG1s Engineered for Enhanced Binding to the Neonatal Fc Receptor (FcRn)", The Journal of Biological Chemistry, vol. 281, No. 33, pp. 23514-23524, Aug. 18, 2006.

(56) References Cited

OTHER PUBLICATIONS

Danese et al., "Anti-TL1A Antibody PF-06480605 Safety and Efficacy for Ulcerative Colitis: A Phase 2a Single-Arm Study", Clinical Gastroenterology and Hepatology, vol. 19, No. 11, pp. 2324-2332, Nov. 2021.
Endo et al., "TL1A (TNFSF15) Genotype Affects the Long-Term Therapeutic Outcomes of Anti-TNFα Antibodies for Crohn's Disease Patients", JGH Open, vol. 4, No. 6, pp. 1108-1113, 2020.
Feagan et al., "The Anti-TL1A Antibody PRA023 Demonstrated Proof-of-Concept in Crohn's Disease: Phase 2a APOLLO-CD Study Results" Abstract, The American Journal of Gastroenterology, vol. 118, Supplement, pp. S875-S876, Oct. 2023.
Haraya et al., "Translational Approach for Predicting Human Pharmacokinetics of Engineered Therapeutic Monoclonal Antibodies with Increased FcRn-Binding Mutations", BioDrugs, vol. 37, No. 1, pp. 99-108, Jan. 2023.
Hassan-Zahraee et al., "Antitumor Necrosis Factor-like Ligand 1A Therapy Targets Tissue Inflammation and Fibrosis Pathways and Reduces Gut Pathobionts in Ulcerative Colitis", Inflammatory Bowel Diseases, vol. 28, No. 3, pp. 434-446, Mar. 2022.
Jackson et al., "Twice-Yearly Depemokimab in Severe Asthma with an Eosinophilic Phenotype", N. Engl. Journal of Medicine, 2024.
Jacob et al., "Direct Signaling of TL1A-DR3 on Fibroblasts Induces Intestinal Fibrosis in Vivo", Nature, vol. 10, 18189, pp. 1-13, 2020.
Jacob et al., "Inflammation Independent TL1A-Mediated Intestinal Fibrosis is Dependent on the Gut Microbiome", Mucosal. Immunol., vol. 11, No. 5, pp. 1466-1476, Sep. 2018.
Kamada et al., "TL1A Produced by Lamina Propria Macrophages Induces Th1 and Th17 Immune Responses in Cooperation with IL-23 in Patients with Crohn's Disease", Inflammatory Bowel Diseases, vol. 16, Iss. 4, pp. 568-575, Apr. 1, 2010.
Kokkotis et al., "TL1A as a Therapeutic Target in Inflammatory Bowel Disease", Expert Review of Clinical Immunology, vol. 18, No. 6, pp. 551-555, Jun. 3, 2022.
Li et al., "TL1A Blocking Ameliorates Intestinal Fibrosis in the T Cell Transfer Model of Chronic Colitis in Mice", Pathology—Research and Practice, vol. 214, Issue 2, pp. 217-227, Feb. 2018.
Ma et al., TL1A Increased IL-6 Production on Fibroblast-Like Synoviocytes by Preferentially Activating TNF Receptor 2 in Rheumatoid Arthritis, Cytokine, vol. 83, pp. 92-98, 2016.
Meylan et al., The TNF-Family Cytokine TL1A Drives IL-13-Dependent Small Intestinal Inflammation, Nature, vol. 4, No. 2, pp. 172-185, Mar. 2011.
Meylan et al., The TNF-Family Cytokine TL1A Promotes Allergic Immunopathology Through Group 2 Innate Lymphoid Cells, Nature, vol. 7, No. 4, pp. 958-968, Jul. 2014.
Michelsen et al., "IBD-Associated TL1A Gene (TNFSF15) Haplotypes Determine Increased Expression of TL1A Protein", PLoS One, vol. 4, Iss. 3, e4719 (1-11), Mar. 2009.
Nowak et al., "A Phase 1 Randomized Dose-Escalation Study of a Human Monoclonal Antibody to IL-6 in CKD", Kidney360, vol. 2, pp. 224-235, Feb. 2021.
Orito et al., "A Phase 1 Study to Evaluate Safety, Pharmacokinetics, and Pharmacodynamics of Respiratory Syncytial Virus Neutralizing Monoclonal Antibody MK-1654 in Healthy Japanese Adults", Clin. Transl. Sci., vol. 15, pp. 1753-1763, 2022.
Pappu et al., "TL1A-DR3 Interaction Regulates Th17 Cell Function and Th17-Mediated Autoimmune Disease", J. Exp. Med., vol. 205, No. 5, pp. 1049-1062, May 12, 2008.
Ramdani et al., "Monoclonal Antibody Engineering and Design to Modulate FcRn Activities: A Comprehensive Review", Int. J. Mol. Sci., vol. 23, No. 17, 9604, pp. 1-12, Aug. 2022.
Raphael et al., "TEV-48574, an Anti-TL1A Antibody I Development for Use in IBD, is Safe and Well Tolerated Following 16 Weeks of Subcutaneous Treatment in Adults with Severe Uncontrolled T2-Low/Non T2 Asthma", Clinical: Therapy and Observation, Abstract Citation ID: jjad212.1191, P1061, Poster Presentations.
Reinisch et al., "Phase 2 Basket Design Study Evaluating the Efficacy and Safety of an Anti-TL1A Antibody (TEV-48574) in Moderate to Severe Ulcerative Colitis or Crohn's Disease (Relieve UCCD)", Clinical: Therapy and Observation, Abstract Citation ID: jjad212.1128, P998, Poster Presentations.
Richard et al., "Reduced Monocyte and Macrophage TNFSF15/TL1A Expression is Associated with Susceptibility to Inflammatory Bowel Disease", PLoS Genetics, vol. 14, No. 9, e1007458, pp. 1-24, Sep. 10, 2018.
Sands et al., "Phase 2 Trial of Anti-TL1A Monoclonal Antibody Tulisokibart for Ulcerative Colitis", N. Engl. Journal of Medicine, vol. 391, No. 12, pp. 1119-1129, Sep. 26, 2024.
Shih et al., "Inhibition of a Novel Fibrogenic Factor Tl1a Reverses Established Colonic Fibrosis", Mucosal Immunol., vol. 7, No. 6, pp. 1492-1503, Nov. 2014.
Siakavellas et al., "Tumor Necrosis Factor-Like Cytokine TL1A and Its Receptors DR3 and DcR3: Important New Factors in Mucosal Homeostasis and Inflammation", Inflamm. Bowel Dis., vol. 21, No. 10, pp. 2441-2452, Oct. 2015.
Singh et al., "A Phase 1 Study of the Long-Acting Anti-IL-5 Monoclonal Antibody GSK3511294 in Patients with Asthma", Br. J. Clin. Pharmacol., vol. 88, No. 2, pp. 702-712, Feb. 2022.
Solitano et al., "TL1A Inhibition for Inflammatory Bowel Disease Treatment: From Inflammation to Fibrosis", Med, vol. 5, pp. 386-400, May 10, 2024.
Song et al., "TL1A Promotes Fibrogenesis in Colonic Fibroblasts via the TGF-β1/Smad3 Signaling Pathway*", Current Medical Science, vol. 44, No. 3, pp. 519-528, 2024.
Takedatsu et al., "TL1A (TNFSF15) Regulates the Development of Chronic Colitis by Modulating Both T-Helper 1 and T-Helper 17 Activation", Gastroenterology, vol. 135, Issue 2, pp. 552-567.e2, Aug. 2008.
Tougaard et al., "Biologics Beyond TNF-a Inhibitors and the Effect of Targeting the Homologues TL1A-DR3 Pathway in Chronic Inflammatory Disorders", Immunopharmacology and Immunotoxicology, vol. 38, No. 1, pp. 29-38, 2016.
Valatas et al., "TL1A (TNFSF15) and DR3 (TNFRSF25): A Co-Stimulatory System of Cytokines With Diverse Functions in Gut Mucosal Immunity", Frontiers in Immunology, vol. 10, Article 583, pp. 1-14, Mar. 2019.
Wenxiu et al., "Effect and Mechanism of TL1A Expression on Epithelial-Mesenchymal Transition during Chronic Colitis-Related Intestinal Fibrosis", Mediators of Inflammation, vol. 2021, No. 1, Article 5927064, pp. 1-21, 2021.
Xu et al., "PCSK9 Inhibitor Recaticimab for Hypercholesterolemia on Stable Statin Dose: a Randomized, Double-Blind, Placebo Controlled Phase 1b/2 Study", BMC Medicine, vol. 20, No. 1, pp. 1-13, Jan. 2022.
Xu et al., "Role of TL1A in Inflammatory Autoimmune Diseases: A Comprehensive Review", Frontiers in Immunology, vol. 13, Art. 891328, pp. 1-10, Jul. 2022.
Zhan et al., "Biochemical and Structural Characterization of the Human TL1A Ectodomain", Biochemistry, vol. 48, No. 32, pp. 7636-7645, 2009.
Zhu et al., "Development and Characterization of SPY002, a Novel Extended Half-Life Monoclonal Antibody Drug Candidate Targeting TL1A for the Treatment of IBD", Clinical: Therapy and Observation, https://academic.oup.com/ecco-jcc/article/18/Supplement_1/11666/7586768, Jul. 22, 2024.
Zhu et al., "Development and Characterization of SPY002, a Novel Extended Half-Life Monoclonal Antibody Drug Candidate Targeting TL1A for the Treatment of IBD", Spyre ECCO Poster P911.
Chiu et al., "Antibody Structure and Function: The Basis for Engineering Therapeutics", Antibodies, vol. 8, Article 55, pp. 1-80, 2019.
Clarke et al., "An anti-TL1A antibody for the treatment of asthma and inflammatory bowel disease", MAbs, vol. 10, No. 4, pp. 664-677, May 19, 2018.
Goel et al., "Plasticity within the Antigen-Combining Site May Manifest as Molecular Mimicry in the Humoral Immune Response", The Journal of Immunology, vol. 173, pp. 7358-7367, 2004.
Janeway et al., "Structure of the Antibody Molecule and Immunoglobulin Genes", Immunobiology, The Immune System in Health and Disease, Third Edition, Part II, Chapter 3, pp. 1-11, Garland Publishing Inc., 1997.

(56) References Cited

OTHER PUBLICATIONS

Kanyavuz et al., "Breaking the Law: Unconventional Strategies for Antibody Diversification", Nature Reviews, Immunology, vol. 19, pp. 355-368, Jun. 2019.
Lloyd et al., "Modelling the human immune response: performance of a 10" human antibody repertoire against a broad panel of therapeutically relevant antigens", Protein Engineering, Design & Selection, vol. 22, No. 3, pp. 159-168, 2009.
Sela-Culang et al., "The Structural Basis of Antibody-Antigen Recognition", Frontiers in Immunology, vol. 4, Article 302, pp. 1-13, Oct. 2013.

* cited by examiner

Absolute values

| | Donor | | | | |
|---|---|---|---|---|---|
| IC50 ng/ml | 1 | 2 | 3 | 4 | avg |
| RVT-3101 | 70.2 | 32.8 | 29.1 | 34.1 | 41.55 |
| MK-7240 | 91.4 | 264.9 | 408.8 | 135.8 | 225.22 |
| Antibody 19 | 23.3 | 8.1 | 21.5 | 9.5 | 15.6 |
| Antibody 47 | 22 | 4.7 | 28.8 | 38 | 23.37 |
| Antibody 49 | 10.429 | 94.742 | 17.206 | 14.773 | 34.287 |
| Antibody 63 | 9.7 | 10.1 | 6.8 | 5.8 | 8.1 |
| Antibody 86 | 37.6 | 11.4 | 25.5 | 28.6 | 25.77 |
| Antibody 92 | 76.137 | 2.732 | 18.905 | 32.293 | 32.517 |

| | Donor | | | | |
|---|---|---|---|---|---|
| normalized to PF | 1 | 2 | 3 | 4 | avg |
| MK-7240 | 1.30 | 8.08 | 14.05 | 3.98 | 6.85 |
| Antibody 19 | 0.33 | 0.25 | 0.74 | 0.28 | 0.40 |
| Antibody 47 | 0.31 | 0.14 | 0.99 | 1.11 | 0.64 |
| Antibody 49 | 0.15 | 2.89 | 0.59 | 0.43 | 1.02 |
| Antibody 63 | 0.14 | 0.31 | 0.23 | 0.17 | 0.21 |
| Antibody 86 | 0.54 | 0.35 | 0.88 | 0.84 | 0.65 |

FIG. 7C

Absolute values

| | Donor | | | | |
|---|---|---|---|---|---|
| IC50 ng/ml | 1 | 2 | 3 | 4 | avg |
| RVT-3101 | 70.2 | 32.8 | 29.1 | 34.1 | 41.55 |
| MK-7240 | 91.4 | 264.9 | 408.8 | 135.8 | 225.22 |
| Antibody 8 | 32.344 | 7.950 | 27.735 | 21.729 | 22.440 |
| Antibody 10 | 21.5 | 5.6 | 20 | 10.8 | 15.26 |

| | Donor | | | | |
|---|---|---|---|---|---|
| normalized to PF | 1 | 2 | 3 | 4 | avg |
| MK-7240 | 1.30 | 8.08 | 14.05 | 3.98 | 6.85 |
| Antibody 8 | 0.46 | 0.24 | 0.95 | 0.64 | 0.57 |
| Antibody 10 | 0.31 | 0.26 | 0.69 | 0.32 | 0.39 |

FIG. 7F

TL1A BINDING PROTEINS AND METHODS OF USE

CROSS-REFERENCE TO RELATED APPLICATIONS

This application is a continuation of International Application No. PCT/US2024/041774, filed Aug. 9, 2024, which claims the benefit of and priority to U.S. Provisional Application No. 63/519,056, filed on Aug. 11, 2023: U.S, Provisional Application No. 63/592,535, filed on Oct. 23, 2023: U.S, Provisional Application No. 63/599,923, filed on Nov. 16, 2023: U.S, Provisional Application No. 63/604,104, filed on Nov. 29, 2023: U.S, Provisional Application No. 63/554,897, filed on Feb. 16, 2024: U.S, Provisional Application No. 63/554,916, filed on Feb. 16, 2024; U.S, Provisional Application No. 63/559,060, filed on Feb. 28, 2024; and U.S, Provisional Application No. 63/559,071, filed on Feb. 28, 2024, the entire contents of each of which are incorporated herein by reference.

SEQUENCE LISTING

This application contains a Sequence Listing which has been submitted electronically in XML format and is hereby incorporated by reference in its entirety. The XML copy, created on Dec. 27, 2024, is titled 220703-010512_US_SL.xml and is 2,191,111 bytes in size.

BACKGROUND

Tumor necrosis factor (TNF)-like cytokine 1A (TL1A) is part of the TNF superfamily and is a transmembrane protein expressed by myeloid mononuclear cells and endothelial cells. TL1A interacts with its receptors, death receptor 3 (DR3) and decoy receptor 3 (DcR3) to trigger signaling. TL1A is elevated in individuals with inflammatory diseases including Crohn's disease and ulcerative colitis, and DR3 expression is upregulated in inflamed tissue. As such. TL1A along with other members of the TNF superfamily have been investigated as therapeutic targets to treat inflammatory diseases including inflammatory bowel diseases. Current biologics targeting TNF are associated with serious side effects highlighting the need for improved therapies targeting TL1A.

SUMMARY OF THE DISCLOSURE

Described herein is a TL1A binding protein, wherein the TL1A binding protein comprises a) a heavy chain variable region (VH) comprising (i) a CDR1 having an amino acid sequence according to SEQ ID NO: 5, or a CDR1 having one to two amino acid substitutions as compared to the sequence of SEQ ID NO: 5, (ii) a CDR2 having an amino acid sequence according to SEQ ID NO: 15, or a CDR2 having one to two amino acid substitutions as compared to the sequence of SEQ ID NO: 15, and (iii) a CDR3 having an amino acid sequence according to SEQ ID NO: 25, or a CDR3 having one to two amino acid substitutions as compared to the sequence of SEQ ID NO: 25; and b) a light chain variable region (VL) comprising (i) a CDR1 having an amino acid sequence according to SEQ ID NO: 35, or a CDR1 having one to two amino acid substitutions as compared to the sequence of SEQ ID NO: 35, (ii) a CDR2 having an amino acid sequence according to SEQ ID NO: 45, or a CDR2 having one to two amino acid substitutions as compared to the sequence of SEQ ID NO: 45, and (iii) a CDR3 having an amino acid sequence according to SEQ ID NO: 55, or a CDR3 having one to two amino acid substitutions as compared to the sequence of SEQ ID NO: 55. In some embodiments, the TL1A binding protein comprises a) a heavy chain variable region (VH) comprising (i) a CDR1 having an amino acid sequence according to SEQ ID NO: 5, (ii) a CDR2 having an amino acid sequence according to SEQ ID NO: 5, and (iii) a CDR3 having an amino acid sequence according to SEQ ID NO: 25; and b) a light chain variable region (VL) comprising (i) a CDR1 having an amino acid sequence according to SEQ ID NO: 35, (ii) a CDR2 having an amino acid sequence according to SEQ ID NO: 45, and (iii) a CDR3 having an amino acid sequence according to SEQ ID NO: 55. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 6, or a CDR1 having one to two amino acid substitutions as compared to the sequence of SEQ ID NO: 6, (ii) a CDR2 having an amino acid sequence according to SEQ ID NO: 16, or a CDR2 having one to two amino acid substitutions as compared to the sequence of SEQ ID NO: 16, and (iii) a CDR3 having an amino acid sequence according to SEQ ID NO: 26, or a CDR3 having one to two amino acid substitutions as compared to the sequence of SEQ ID NO: 26; and b) a light chain variable region (VL) comprising (i) a CDR1 having an amino acid sequence according to SEQ ID NO: 36, or a CDR1 having one to two amino acid substitutions as compared to the sequence of SEQ ID NO: 36, (ii) a CDR2 having an amino acid sequence according to SEQ ID NO: 46, or a CDR2 having one to two amino acid substitutions as compared to the sequence of SEQ ID NO: 46, and (iii) a CDR3 having an amino acid sequence according to SEQ ID NO: 56, or a CDR3 having one to two amino acid substitutions as compared to the sequence of SEQ ID NO: 56. In some embodiments, the TL1A binding protein comprises a) a heavy chain variable region (VH) comprising (i) a CDR1 having an amino acid sequence according to SEQ ID NO: 6, (ii) a CDR2 having an amino acid sequence according to SEQ ID NO: 6, and (iii) a CDR3 having an amino acid sequence according to SEQ ID NO: 26; and b) a light chain variable region (VL) comprising (i) a CDR1 having an amino acid sequence according to SEQ ID NO: 36, (ii) a CDR2 having an amino acid sequence according to SEQ ID NO: 46, and (iii) a CDR3 having an amino acid sequence according to SEQ ID NO: 56. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 7, or a CDR1 having one to two amino acid substitutions as compared to the sequence of SEQ ID NO: 7, (ii) a CDR2 having an amino acid sequence according to SEQ ID NO: 17, or a CDR2 having one to two amino acid substitutions as compared to the sequence of SEQ ID NO: 17, and (iii) a CDR3 having an amino acid sequence according to SEQ ID NO: 27, or a CDR3 having one to two amino acid substitutions as compared to the sequence of SEQ ID NO: 27; and b) a light chain variable region (VL) comprising (i) a CDR1 having an amino acid sequence according to SEQ ID NO: 37, or a CDR1 having one to two amino acid substitutions as compared to the sequence of SEQ ID NO: 37, (ii) a CDR2 having an amino acid sequence according to SEQ ID NO: 47, or a CDR2 having one to two amino acid substitutions as compared to the sequence of SEQ ID NO: 47, and (iii) a CDR3 having an amino acid sequence according to SEQ ID NO: 57, or a CDR3 having one to two amino acid substitutions as compared to the sequence of SEQ ID NO: 57. In some embodiments, the TL1A binding protein comprises a) a heavy chain variable region (VH) comprising (i) a CDR1 having an amino acid sequence according to SEQ ID NO: 7, (ii) a CDR2 having an amino acid sequence according to SEQ ID NO: 17, and (iii) a CDR3 having an amino acid sequence according to SEQ ID NO: 27; and b) a light chain variable region (VL) comprising (i) a CDR1 having an amino acid sequence according to SEQ ID NO: 37, (ii) a CDR2 having an amino acid sequence according to SEQ ID NO: 47, and (iii) a CDR3 having an amino acid sequence according to SEQ ID NO: 57. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 8, or a CDR1 having one to two amino acid substitutions as compared to the sequence of SEQ ID NO: 8, (ii) a CDR2 having an amino acid sequence according to SEQ ID NO: 18, or a CDR2 having one to two amino acid substitutions as compared to the sequence of SEQ ID NO: 18, and (iii) a CDR3 having an amino acid sequence according to SEQ ID NO: 28, or a CDR3 having one to two amino acid substitutions as compared to the sequence of SEQ ID NO: 28; and b) a light chain variable region (VL) comprising (i) a CDR1 having an amino acid sequence according to SEQ ID NO: 38, or a CDR1 having one to two amino acid substitutions as compared to the sequence of SEQ ID NO: 38, (ii) a CDR2 having an amino acid sequence according to SEQ ID NO: 48, or a CDR2 having one to two amino acid substitutions as compared to the sequence of SEQ ID NO: 48, and (iii) a CDR3 having an amino acid sequence according to SEQ ID NO: 58, or a CDR3 having one to two amino acid substitutions as compared to the sequence of SEQ ID NO: 58. In some embodiments, the TL1A binding protein comprises a) a heavy chain variable region (VH) comprising (i) a CDR1 having an amino acid sequence according to SEQ ID NO: 8, (ii) a CDR2 having an amino acid sequence according to SEQ ID NO: 18, and (iii) a CDR3 having an amino acid sequence according to SEQ ID NO: 28; and b) a light chain variable region (VL) comprising (i) a CDR1 having an amino acid sequence according to SEQ ID NO: 38, (ii) a CDR2 having an amino acid sequence according to SEQ ID NO: 48, and (iii) a CDR3 having an amino acid sequence according to SEQ ID NO: 58. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 9, or a CDR1 having one to two amino acid substitutions as compared to the sequence of SEQ ID NO: 9, (ii) a CDR2 having an amino acid sequence according to SEQ ID NO: 19, or a CDR2 having one to two amino acid substitutions as compared to the sequence of SEQ ID NO: 19, and (iii) a CDR3 having an amino acid sequence according to SEQ ID NO: 29, or a CDR3 having one to two amino acid substitutions as compared to the sequence of SEQ ID NO: 29; and b) a light chain variable region (VL) comprising (i) a CDR1 having an amino acid sequence according to SEQ ID NO: 39, or a CDR1 having one to two amino acid substitutions as compared to the sequence of SEQ ID NO:39, (ii) a CDR2 having an amino acid sequence according to SEQ ID NO: 49, or a CDR2 having one to two amino acid substitutions as compared to the sequence of SEQ ID NO: 49, and (iii) a CDR3 having an amino acid sequence according to SEQ ID NO: 59, or a CDR3 having one to two amino acid substitutions as compared to the sequence of SEQ ID NO: 59. In some embodiments, the TL1A binding protein comprises a) a heavy chain variable region (VH) comprising (i) a CDR1 having an amino acid sequence according to SEQ ID NO: 9, (ii) a CDR2 having an amino acid sequence according to SEQ ID NO: 19, and (iii) a CDR3 having an amino acid sequence according to SEQ ID NO: 29; and a light chain variable region (VL) comprising (i) a CDR1 having an amino acid sequence according to SEQ ID NO: 39, (ii) a CDR2 having an amino acid sequence according to SEQ ID NO: 49, and (iii) a CDR3 having an amino acid sequence according to SEQ ID NO: 59. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 10, or a CDR1 having one to two amino acid substitutions as compared to the sequence of SEQ ID NO: 10, (ii) a CDR2 having an amino acid sequence according to SEQ ID NO: 20, or a CDR2 having one to two amino acid substitutions as compared to the sequence of SEQ ID NO: 20, and (iii) a CDR3 having an amino acid sequence according to SEQ ID NO: 30, or a CDR3 having one to two amino acid substitutions as compared to the sequence of SEQ ID NO: 30; and b) a light chain variable region (VL) comprising (i) a CDR1 having an amino acid sequence according to SEQ ID NO: 40, or a CDR1 having one to two amino acid substitutions as compared to the sequence of SEQ ID NO: 40, (ii) a CDR2 having an amino acid sequence according to SEQ ID NO: 50, or a CDR2 having one to two amino acid substitutions as compared to the sequence of SEQ ID NO: 50, and (iii) a CDR3 having an amino acid sequence according to SEQ ID NO: 60, or a CDR3 having one to two amino acid substitutions as compared to the sequence of SEQ ID NO: 60. In some embodiments, the TL1A binding protein comprises a) a heavy chain variable region (VH) comprising (i) a CDR1 having an amino acid sequence according to SEQ ID NO: 10, (ii) a CDR2 having an amino acid sequence according to SEQ ID NO: 20, and (iii) a CDR3 having an amino acid sequence according to SEQ ID NO: 30; and a light chain variable region (VL) comprising (i) a CDR1 having an amino acid sequence according to SEQ ID NO: 40, (ii) a CDR2 having an amino acid sequence according to SEQ ID NO: 50, and (iii) a CDR3 having an amino acid sequence according to SEQ ID NO: 60. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 1, or a CDR1 having one to two amino acid substitutions as compared to the sequence of SEQ ID NO: 1, (ii) a CDR2 having an amino acid sequence according to SEQ ID NO: 11, or a CDR2 having one to two amino acid substitutions as compared to the sequence of SEQ ID NO: 11, and (iii) a CDR3 having an amino acid sequence according to SEQ ID NO: 21, or a CDR3 having one to two amino acid substitutions as compared to the sequence of SEQ ID NO: 21; and b) a light chain variable region (VL) comprising (i) a CDR1 having an amino acid sequence according to SEQ ID NO: 31, or a CDR1 having one to two amino acid substitutions as compared to the sequence of SEQ ID NO: 31, (ii) a CDR2 having an amino acid sequence according to SEQ ID NO: 41, or a CDR2 having one to two amino acid substitutions as compared to the sequence of SEQ ID NO: 41, and (iii) a CDR3 having an amino acid sequence according to SEQ ID NO: 51, or a CDR3 having one to two amino acid substitutions as compared to the sequence of SEQ ID NO: 51. In some embodiments, the TL1A binding protein comprises a) a heavy chain variable region (VH) comprising (i) a CDR1 having an amino acid sequence according to SEQ ID NO: 1, (ii) a CDR2 having an amino acid sequence according to SEQ ID NO: 11, and (iii) a CDR3 having an amino acid sequence according to SEQ ID NO: 21; and b) a light chain variable region (VL) comprising (i) a CDR1 having an amino acid sequence according to SEQ ID NO: 31, (ii) a CDR2 having an amino acid sequence according to SEQ ID NO: 41, and (iii) a CDR3 having an amino acid sequence according to SEQ ID NO: 51. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 2, or a CDR1 having one to two amino acid substitutions as compared to the sequence of SEQ ID NO: 2, (ii) a CDR2 having an amino acid sequence according to SEQ ID NO: 12, or a CDR2 having one to two amino acid substitutions as compared to the sequence of SEQ ID NO: 12, and (iii) a CDR3 having an amino acid sequence according to SEQ ID NO: 22, or a CDR3 having one to two amino acid substitutions as compared to the sequence of SEQ ID NO: 22; and a light chain variable region (VL) comprising (i) a CDR1 having an amino acid sequence according to SEQ ID NO: 32, or a CDR1 having one to two amino acid substitutions as compared to the sequence of SEQ ID NO: 32, (ii) a CDR2 having an amino acid sequence according to SEQ ID NO: 42, or a CDR2 having one to two amino acid substitutions as compared to the sequence of SEQ ID NO: 42, and (iii) a CDR3 having an amino acid sequence according to SEQ ID NO: 52, or a CDR3 having one to two amino acid substitutions as compared to the sequence of SEQ ID NO: 52. In some embodiments, the TL1A binding protein comprises a) a heavy chain variable region (VH) comprising (i) a CDR1 having an amino acid sequence according to SEQ ID NO: 2, (ii) a CDR2 having an amino acid sequence according to SEQ ID NO: 12, and (iii) a CDR3 having an amino acid sequence according to SEQ ID NO: 22; and b) a light chain variable region (VL) comprising (i) a CDR1 having an amino acid sequence according to SEQ ID NO: 32, (ii) a CDR2 having an amino acid sequence according to SEQ ID NO: 42, and (iii) a CDR3 having an amino acid sequence according to SEQ ID NO: 52. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 3, or a CDR1 having one to two amino acid substitutions as compared to the sequence of SEQ ID NO: 3, (ii) a CDR2 having an amino acid sequence according to SEQ ID NO: 13, or a CDR2 having one to two amino acid substitutions as compared to the sequence of SEQ ID NO: 13, and (iii) a CDR3 having an amino acid sequence according to SEQ ID NO: 23, or a CDR3 having one to two amino acid substitutions as compared to the sequence of SEQ ID NO: 23; and b) a light chain variable region (VL) comprising (i) a CDR1 having an amino acid sequence according to SEQ ID NO: 33, or a CDR1 having one to two amino acid substitutions as compared to the sequence of SEQ ID NO: 33, (ii) a CDR2 having an amino acid sequence according to SEQ ID NO: 43, or a CDR2 having one to two amino acid substitutions as compared to the sequence of SEQ ID NO: 43, and (iii) a CDR3 having an amino acid sequence according to SEQ ID NO: 53, or a CDR3 having one to two amino acid substitutions as compared to the sequence of SEQ ID NO: 53. In some embodiments, the TL1A binding protein comprises a) a heavy chain variable region (VH) comprising (i) a CDR1 having an amino acid sequence according to SEQ ID NO: 3, (ii) a CDR2 having an amino acid sequence according to SEQ ID NO: 13, and (iii) a CDR3 having an amino acid sequence according to SEQ ID NO: 23; and b) a light chain variable region (VL) comprising (i) a CDR1 having an amino acid sequence according to SEQ ID NO: 33, (ii) a CDR2 having an amino acid sequence according to SEQ ID NO: 43, and (iii) a CDR3 having an amino acid sequence according to SEQ ID NO: 53. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 4, or a CDR1 having one to two amino acid substitutions as compared to the sequence of SEQ ID NO: 4, (ii) a CDR2 having an amino acid sequence according to SEQ ID NO: 14, or a CDR2 having one to two amino acid substitutions as compared to the sequence of SEQ ID NO: 14, and (iii) a CDR3 having an amino acid sequence according to SEQ ID NO: 24, or a CDR3 having one to two amino acid substitutions as compared to the sequence of SEQ ID NO: 24; and a light chain variable region (VL) comprising (i) a CDR1 having an amino acid sequence according to SEQ ID NO: 34, or a CDR1 having one to two amino acid substitutions as compared to the sequence of SEQ ID NO: 34, (ii) a CDR2 having an amino acid sequence according to SEQ ID NO: 44, or a CDR2 having one to two amino acid substitutions as compared to the sequence of SEQ ID NO: 44, and (iii) a CDR3 having an amino acid sequence according to SEQ ID NO: 54, or a CDR3 having one to two amino acid substitutions as compared to the sequence of SEQ ID NO: 54. In some embodiments, the TL1A binding protein comprises a) a heavy chain variable region (VH) comprising (i) a CDR1 having an amino acid sequence according to SEQ ID NO: 4, (ii) a CDR2 having an amino acid sequence according to SEQ ID NO: 14, and (iii) a CDR3 having an amino acid sequence according to SEQ ID NO: 24; and b) a light chain variable region (VL) comprising (i) a CDR1 having an amino acid sequence according to SEQ ID NO: 34, (ii) a CDR2 having an amino acid sequence according to SEQ ID NO: 44, and (iii) a CDR3 having an amino acid sequence according to SEQ ID NO: 54. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 321, or a CDR1 having one to two amino acid substitutions as compared to the sequence of SEQ ID NO: 321, (ii) a CDR2 having an amino acid sequence according to SEQ ID NO: 430, or a CDR2 having one to two amino acid substitutions as compared to the sequence of SEQ ID NO: 430, and (iii) a CDR3 having an amino acid sequence according to SEQ ID NO: 539, or a CDR3 having one to two amino acid substitutions as compared to the sequence of SEQ ID NO: 539; and a light chain variable region (VL) comprising (i) a CDR1 having an amino acid sequence according to SEQ ID NO: 648, or a CDR1 having one to two amino acid substitutions as compared to the sequence of SEQ ID NO: 648, (ii) a CDR2 having an amino acid sequence according to SEQ ID NO: 757, or a CDR2 having one to two amino acid substitutions as compared to the sequence of SEQ ID NO: 757, and (iii) a CDR3 having an amino acid sequence according to SEQ ID NO: 866, or a CDR3 having one to two amino acid substitutions as compared to the sequence of SEQ ID NO: 866. In some embodiments, the TL1A binding protein comprises a) a heavy chain variable region (VH) comprising (i) a CDR1 having an amino acid sequence according to SEQ ID NO: 321, (ii) a CDR2 having an amino acid sequence according to SEQ ID NO: 430, and (iii) a CDR3 having an amino acid sequence according to SEQ ID NO: 539; and b) a light chain variable region (VL) comprising (i) a CDR1 having an amino acid sequence according to SEQ ID NO: 648, (ii) a CDR2 having an amino acid sequence according to SEQ ID NO: 757, and (iii) a CDR3 having an amino acid sequence according to SEQ ID NO: 866. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 341, or a CDR1 having one to two amino acid substitutions as compared to the sequence of SEQ ID NO: 341, (ii) a CDR2 having an amino acid sequence according to SEQ ID NO: 450, or a CDR2 having one to two amino acid substitutions as compared to the sequence of SEQ ID NO: 450, and (iii) a CDR3 having an amino acid sequence according to SEQ ID NO: 559, or a CDR3 having one to two amino acid substitutions as compared to the sequence of SEQ ID NO: 559; and b) a light chain variable region (VL) comprising (i) a CDR1 having an amino acid sequence according to SEQ ID NO: 668, or a CDR1 having one to two amino acid substitutions as compared to the sequence of SEQ ID NO: 668, (ii) a CDR2 having an amino acid sequence according to SEQ ID NO: 777, or a CDR2 having one to two amino acid substitutions as compared to the sequence of SEQ ID NO: 777, and (iii) a CDR3 having an amino acid sequence according to SEQ ID NO: 886, or a CDR3 having one to two amino acid substitutions as compared to the sequence of SEQ ID NO: 886. In some embodiments, the TL1A binding protein comprises a) a heavy chain variable region (VH) comprising (i) a CDR1 having an amino acid sequence according to SEQ ID NO: 341, (ii) a CDR2 having an amino acid sequence according to SEQ ID NO: 450, and (iii) a CDR3 having an amino acid sequence according to SEQ ID NO: 559; and b) a light chain variable region (VL) comprising (i) a CDR1 having an amino acid sequence according to SEQ ID NO: 668, (ii) a CDR2 having an amino acid sequence according to SEQ ID NO: 777, and (iii) a CDR3 having an amino acid sequence according to SEQ ID NO: 886. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 345, or a CDR1 having one to two amino acid substitutions as compared to the sequence of SEQ ID NO: 345, (ii) a CDR2 having an amino acid sequence according to SEQ ID NO: 454, or a CDR2 having one to two amino acid substitutions as compared to the sequence of SEQ ID NO: 454, and (iii) a CDR3 having an amino acid sequence according to SEQ ID NO: 563, or a CDR3 having one to two amino acid substitutions as compared to the sequence of SEQ ID NO: 563; and b) a light chain variable region (VL) comprising (i) a CDR1 having an amino acid sequence according to SEQ ID NO: 672, or a CDR1 having one to two amino acid substitutions as compared to the sequence of SEQ ID NO: 672, (ii) a CDR2 having an amino acid sequence according to SEQ ID NO: 781, or a CDR2 having one to two amino acid substitutions as compared to the sequence of SEQ ID NO: 781, and (iii) a CDR3 having an amino acid sequence according to SEQ ID NO: 890, or a CDR3 having one to two amino acid substitutions as compared to the sequence of SEQ ID NO: 890. In some embodiments, the TL1A binding protein comprises a) a heavy chain variable region (VH) comprising (i) a CDR1 having an amino acid sequence according to SEQ ID NO: 345, (ii) a CDR2 having an amino acid sequence according to SEQ ID NO: 454, and (iii) a CDR3 having an amino acid sequence according to SEQ ID NO: 563; and b) a light chain variable region (VL) comprising (i) a CDR1 having an amino acid sequence according to SEQ ID NO: 672, (ii) a CDR2 having an amino acid sequence according to SEQ ID NO: 781, and (iii) a CDR3 having an amino acid sequence according to SEQ ID NO: 890. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 349, or a CDR1 having one to two amino acid substitutions as compared to the sequence of SEQ ID NO: 349, (ii) a CDR2 having an amino acid sequence according to SEQ ID NO: 458, or a CDR2 having one to two amino acid substitutions as compared to the sequence of SEQ ID NO: 458, and (iii) a CDR3 having an amino acid sequence according to SEQ ID NO: 567, or a CDR3 having one to two amino acid substitutions as compared to the sequence of SEQ ID NO: 567; and b) a light chain variable region (VL) comprising (i) a CDR1 having an amino acid sequence according to SEQ ID NO: 676, or a CDR1 having one to two amino acid substitutions as compared to the sequence of SEQ ID NO: 676, (ii) a CDR2 having an amino acid sequence according to SEQ ID NO: 785, or a CDR2 having one to two amino acid substitutions as compared to the sequence of SEQ ID NO: 785, and (iii) a CDR3 having an amino acid sequence according to SEQ ID NO: 894, or a CDR3 having one to two amino acid substitutions as compared to the sequence of SEQ ID NO: 894. In some embodiments, the TL1A binding protein comprises a) a heavy chain variable region (VH) comprising (i) a CDR1 having an amino acid sequence according to SEQ ID NO: 349, (ii) a CDR2 having an amino acid sequence according to SEQ ID NO: 458, and (iii) a CDR3 having an amino acid sequence according to SEQ ID NO: 567; and b) a light chain variable region (VL) comprising (i) a CDR1 having an amino acid sequence according to SEQ ID NO: 676, (ii) a CDR2 having an amino acid sequence according to SEQ ID NO: 785, and (iii) a CDR3 having an amino acid sequence according to SEQ ID NO: 894. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 351, or a CDR1 having one to two amino acid substitutions as compared to the sequence of SEQ ID NO: 351, (ii) a CDR2 having an amino acid sequence according to SEQ ID NO: 460, or a CDR2 having one to two amino acid substitutions as compared to the sequence of SEQ ID NO: 460; and (iii) a CDR3 having an amino acid sequence according to SEQ ID NO: 569, or a CDR3 having one to two amino acid substitutions as compared to the sequence of SEQ ID NO: 569; and b) a light chain variable region (VL) comprising (i) a CDR1 having an amino acid sequence according to SEQ ID NO: 678, or a CDR1 having one to two amino acid substitutions as compared to the sequence of SEQ ID NO: 678, (ii) a CDR2 having an amino acid sequence according to SEQ ID NO: 787, or a CDR2 having one to two amino acid substitutions as compared to the sequence of SEQ ID NO: 787; and (iii) a CDR3 having an amino acid sequence according to SEQ ID NO: 896, or a CDR3 having one to two amino acid substitutions as compared to the sequence of SEQ ID NO: 896. In some embodiments, the TL1A binding protein comprises a) a heavy chain variable region (VH) comprising (i) a CDR1 having an amino acid sequence according to SEQ ID NO: 351, (ii) a CDR2 having an amino acid sequence according to SEQ ID NO: 460; and (iii) a CDR3 having an amino acid sequence according to SEQ ID NO: 569; and b) a light chain variable region (VL) comprising (i) a CDR1 having an amino acid sequence according to SEQ ID NO: 678, (ii) a CDR2 having an amino acid sequence according to SEQ ID NO: 787; and (iii) a CDR3 having an amino acid sequence according to SEQ ID NO: 896. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 354, or a CDR1 having one to two amino acid substitutions as compared to the sequence of SEQ ID NO: 354, (ii) a CDR2 having an amino acid sequence according to SEQ ID NO: 463, or a CDR2 having one to two amino acid substitutions as compared to the sequence of SEQ ID NO: 463, and (iii) a CDR3 having an amino acid sequence according to SEQ ID NO: 572, or a CDR3 having one to two amino acid substitutions as compared to the sequence of SEQ ID NO: 572; and b) a light chain variable region (VL) comprising (i) a CDR1 having an amino acid sequence according to SEQ ID NO: 681, or a CDR1 having one to two amino acid substitutions as compared to the sequence of SEQ ID NO: 681, (ii) a CDR2 having an amino acid sequence according to SEQ ID NO: 790, or a CDR2 having one to two amino acid substitutions as compared to the sequence of SEQ ID NO: 790, and (iii) a CDR3 having an amino acid sequence according to SEQ ID NO: 899, or a CDR3 having one to two amino acid substitutions as compared to the sequence of SEQ ID NO: 899. In some embodiments, the TL1A binding protein comprises a) a heavy chain variable region (VH) comprising (i) a CDR1 having an amino acid sequence according to SEQ ID NO: 354, (ii) a CDR2 having an amino acid sequence according to SEQ ID NO: 463, and (iii) a CDR3 having an amino acid sequence according to SEQ ID NO: 572; and b) a light chain variable region (VL) comprising (i) a CDR1 having an amino acid sequence according to SEQ ID NO: 681, (ii) a CDR2 having an amino acid sequence according to SEQ ID NO: 790, and (iii) a CDR3 having an amino acid sequence according to SEQ ID NO: 899. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 365, or a CDR1 having one to two amino acid substitutions as compared to the sequence of SEQ ID NO: 365, (ii) a CDR2 having an amino acid sequence according to SEQ ID NO: 474, or a CDR2 having one to two amino acid substitutions as compared to the sequence of SEQ ID NO: 474, and (iii) a CDR3 having an amino acid sequence according to SEQ ID NO: 583, or a CDR3 having one to two amino acid substitutions as compared to the sequence of SEQ ID NO: 583; and a light chain variable region (VL) comprising (i) a CDR1 having an amino acid sequence according to SEQ ID NO: 692, or a CDR1 having one to two amino acid substitutions as compared to the sequence of SEQ ID NO: 692, (ii) a CDR2 having an amino acid sequence according to SEQ ID NO: 801, or a CDR2 having one to two amino acid substitutions as compared to the sequence of SEQ ID NO: 801, and (iii) a CDR3 having an amino acid sequence according to SEQ ID NO: 910, or a CDR3 having one to two amino acid substitutions as compared to the sequence of SEQ ID NO: 910. In some embodiments, the TL1A binding protein comprises a) a heavy chain variable region (VH) comprising (i) a CDR1 having an amino acid sequence according to SEQ ID NO: 365, (ii) a CDR2 having an amino acid sequence according to SEQ ID NO: 474, and (iii) a CDR3 having an amino acid sequence according to SEQ ID NO: 583; and b) a light chain variable region (VL) comprising (i) a CDR1 having an amino acid sequence according to SEQ ID NO: 692, (ii) a CDR2 having an amino acid sequence according to SEQ ID NO: 801, and (iii) a CDR3 having an amino acid sequence according to SEQ ID NO: 910. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 371, or a CDR1 having one to two amino acid substitutions as compared to the sequence of SEQ ID NO: 371, (ii) a CDR2 having an amino acid sequence according to SEQ ID NO: 480, or a CDR2 having one to two amino acid substitutions as compared to the sequence of SEQ ID NO: 480, and (iii) a CDR3 having an amino acid sequence according to SEQ ID NO: 589, or a CDR3 having one to two amino acid substitutions as compared to the sequence of SEQ ID NO: 589; and b) a light chain variable region (VL) comprising (i) a CDR1 having an amino acid sequence according to SEQ ID NO: 698, or a CDR1 having one to two amino acid substitutions as compared to the sequence of SEQ ID NO: 698, (ii) a CDR2 having an amino acid sequence according to SEQ ID NO: 807, or a CDR2 having one to two amino acid substitutions as compared to the sequence of SEQ ID NO: 807, and (iii) a CDR3 having an amino acid sequence according to SEQ ID NO: 916, or a CDR3 having one to two amino acid substitutions as compared to the sequence of SEQ ID NO: 916. In some embodiments, the TL1A binding protein comprises a) a heavy chain variable region (VH) comprising (i) a CDR1 having an amino acid sequence according to SEQ ID NO: 371, (ii) a CDR2 having an amino acid sequence according to SEQ ID NO: 480, and (iii) a CDR3 having an amino acid sequence according to SEQ ID NO: 589; and b) a light chain variable region (VL) comprising (i) a CDR1 having an amino acid sequence according to SEQ ID NO: 698, (ii) a CDR2 having an amino acid sequence according to SEQ ID NO: 807, and (iii) a CDR3 having an amino acid sequence according to SEQ ID NO: 916. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 372, or a CDR1 having one to two amino acid substitutions as compared to the sequence of SEQ ID NO: 372, (ii) a CDR2 having an amino acid sequence according to SEQ ID NO: 481, or a CDR2 having one to two amino acid substitutions as compared to the sequence of SEQ ID NO: 481, and (iii) a CDR3 having an amino acid sequence according to SEQ ID NO: 590, or a CDR3 having one to two amino acid substitutions as compared to the sequence of SEQ ID NO: 590; and b) a light chain variable region (VL) comprising (i) a CDR1 having an amino acid sequence according to SEQ ID NO: 699, or a CDR1 having one to two amino acid substitutions as compared to the sequence of SEQ ID NO: 699, (ii) a CDR2 having an amino acid sequence according to SEQ ID NO: 808, or a CDR2 having one to two amino acid substitutions as compared to the sequence of SEQ ID NO: 808, and (iii) a CDR3 having an amino acid sequence according to SEQ ID NO: 917, or a CDR3 having one to two amino acid substitutions as compared to the sequence of SEQ ID NO: 917. In some embodiments, the TL1A binding protein comprises a) a heavy chain variable region (VH) comprising (i) a CDR1 having an amino acid sequence according to SEQ ID NO: 372, (ii) a CDR2 having an amino acid sequence according to SEQ ID NO: 481, and (iii) a CDR3 having an amino acid sequence according to SEQ ID NO: 590; and b) a light chain variable region (VL) comprising (i) a CDR1 having an amino acid sequence according to SEQ ID NO: 699, (ii) a CDR2 having an amino acid sequence according to SEQ ID NO: 808, and (iii) a CDR3 having an amino acid sequence according to SEQ ID NO: 917. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 373, or a CDR1 having one to two amino acid substitutions as compared to the sequence of SEQ ID NO: 373, (ii) a CDR2 having an amino acid sequence according to SEQ ID NO: 482, or a CDR2 having one to two amino acid substitutions as compared to the sequence of SEQ ID NO: 482, and (iii) a CDR3 having an amino acid sequence according to SEQ ID NO: 591, or a CDR3 having one to two amino acid substitutions as compared to the sequence of SEQ ID NO: 591; and a light chain variable region (VL) comprising (i) a CDR1 having an amino acid sequence according to SEQ ID NO: 700, or a CDR1 having one to two amino acid substitutions as compared to the sequence of SEQ ID NO: 700, (ii) a CDR2 having an amino acid sequence according to SEQ ID NO: 809, or a CDR2 having one to two amino acid substitutions as compared to the sequence of SEQ ID NO: 809, and (iii) a CDR3 having an amino acid sequence according to SEQ ID NO: 918, or a CDR3 having one to two amino acid substitutions as compared to the sequence of SEQ ID NO: 918. In some embodiments, the TL1A binding protein comprises a) a heavy chain variable region (VH) comprising (i) a CDR1 having an amino acid sequence according to SEQ ID NO: 373, (ii) a CDR2 having an amino acid sequence according to SEQ ID NO: 482, and (iii) a CDR3 having an amino acid sequence according to SEQ ID NO: 591; and b) a light chain variable region (VL) comprising (i) a CDR1 having an amino acid sequence according to SEQ ID NO: 700, (ii) a CDR2 having an amino acid sequence according to SEQ ID NO: 809, and (iii) a CDR3 having an amino acid sequence according to SEQ ID NO: 918. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 388, or a CDR1 having one to two amino acid substitutions as compared to the sequence of SEQ ID NO: 388, (ii) a CDR2 having an amino acid sequence according to SEQ ID NO: 497, or a CDR2 having one to two amino acid substitutions as compared to the sequence of SEQ ID NO: 497, and (iii) a CDR3 having an amino acid sequence according to SEQ ID NO: 606, or a CDR3 having one to two amino acid substitutions as compared to the sequence of SEQ ID NO: 606; and a light chain variable region (VL) comprising (i) a CDR1 having an amino acid sequence according to SEQ ID NO: 715, or a CDR1 having one to two amino acid substitutions as compared to the sequence of SEQ ID NO: 715, (ii) a CDR2 having an amino acid sequence according to SEQ ID NO: 824, or a CDR2 having one to two amino acid substitutions as compared to the sequence of SEQ ID NO: 824, and (iii) a CDR3 having an amino acid sequence according to SEQ ID NO: 933, or a CDR3 having one to two amino acid substitutions as compared to the sequence of SEQ ID NO: 933. In some embodiments, the TL1A binding protein comprises a) a heavy chain variable region (VH) comprising (i) a CDR1 having an amino acid sequence according to SEQ ID NO: 388, (ii) a CDR2 having an amino acid sequence according to SEQ ID NO: 497, and (iii) a CDR3 having an amino acid sequence according to SEQ ID NO: 606; and b) a light chain variable region (VL) comprising (i) a CDR1 having an amino acid sequence according to SEQ ID NO: 715, (ii) a CDR2 having an amino acid sequence according to SEQ ID NO: 824, and (iii) a CDR3 having an amino acid sequence according to SEQ ID NO: 933. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 394, or a CDR1 having one to two amino acid substitutions as compared to the sequence of SEQ ID NO: 394, (ii) a CDR2 having an amino acid sequence according to SEQ ID NO: 503, or a CDR2 having one to two amino acid substitutions as compared to the sequence of SEQ ID NO: 503, and (iii) a CDR3 having an amino acid sequence according to SEQ ID NO: 612, or a CDR3 having one to two amino acid substitutions as compared to the sequence of SEQ ID NO: 612; and b) a light chain variable region (VL) comprising (i) a CDR1 having an amino acid sequence according to SEQ ID NO: 721, or a CDR1 having one to two amino acid substitutions as compared to the sequence of SEQ ID NO: 721, (ii) a CDR2 having an amino acid sequence according to SEQ ID NO: 830, or a CDR2 having one to two amino acid substitutions as compared to the sequence of SEQ ID NO: 830, and (iii) a CDR3 having an amino acid sequence according to SEQ ID NO: 939, or a CDR3 having one to two amino acid substitutions as compared to the sequence of SEQ ID NO: 939. In some embodiments, the TL1A binding protein comprises a) a heavy chain variable region (VH) comprising (i) a CDR1 having an amino acid sequence according to SEQ ID NO: 394, (ii) a CDR2 having an amino acid sequence according to SEQ ID NO: 503, and (iii) a CDR3 having an amino acid sequence according to SEQ ID NO: 612; and b) a light chain variable region (VL) comprising (i) a CDR1 having an amino acid sequence according to SEQ ID NO: 721, (ii) a CDR2 having an amino acid sequence according to SEQ ID NO: 830, and (iii) a CDR3 having an amino acid sequence according to SEQ ID NO: 939. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 400, or a CDR1 having one to two amino acid substitutions as compared to the sequence of SEQ ID NO: 400, (ii) a CDR2 having an amino acid sequence according to SEQ ID NO: 509, or a CDR2 having one to two amino acid substitutions as compared to the sequence of SEQ ID NO: 509, and (iii) a CDR3 having an amino acid sequence according to SEQ ID NO: 618, or a CDR3 having one to two amino acid substitutions as compared to the sequence of SEQ ID NO: 618; and b) a light chain variable region (VL) comprising (i) a CDR1 having an amino acid sequence according to SEQ ID NO: 727, or a CDR1 having one to two amino acid substitutions as compared to the sequence of SEQ ID NO: 727, (ii) a CDR2 having an amino acid sequence according to SEQ ID NO: 836, or a CDR2 having one to two amino acid substitutions as compared to the sequence of SEQ ID NO: 836, and (iii) a CDR3 having an amino acid sequence according to SEQ ID NO: 945, or a CDR3 having one to two amino acid substitutions as compared to the sequence of SEQ ID NO: 945. In some embodiments, the TL1A binding protein comprises a) a heavy chain variable region (VH) comprising (i) a CDR1 having an amino acid sequence according to SEQ ID NO: 400, (ii) a CDR2 having an amino acid sequence according to SEQ ID NO: 509, and (iii) a CDR3 having an amino acid sequence according to SEQ ID NO: 618; and b) a light chain variable region (VL) comprising (i) a CDR1 having an amino acid sequence according to SEQ ID NO: 727, (ii) a CDR2 having an amino acid sequence according to SEQ ID NO: 836, and (iii) a CDR3 having an amino acid sequence according to SEQ ID NO: 945. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Aspects of the disclosure relate to TL1A binding antibody that specifically binds to an epitope on a TL1A polypeptide recognized by an antibody disclosed herein, Aspects of the disclosure relate to TL1A binding antibody that specifically binds to an epitope on a TL1A polypeptide recognized by antibody 1, 2, 3, 4, 6, 8, 10, 47, 49, 63, or 69 disclosed herein.

Aspects of the disclosure relate to TL1A binding antibody that binds specifically to a TL1A polypeptide comprising SEQ ID NO: 2493 at any one of amino acid residues Val 101, Val 102, Arg 103, Gln 104, Thr 105, Pro 106, Thr 107, Gln 108, His 109, Phe 110, Lys 111, His 118, Trp 119, Glu 120, Glu 122, Leu 123, Gly 124, Lys 137, Arg 156, Gly 157, Met 158, Ser 231, Asp 232, Ile 233, Ser 234, Tyr 238, Thr 239, Lys 240, and Lys 243. In some embodiments, the TL1A binding antibody specifically binds to the TL1A sequences at ten or more amino acid residues selected from Val 102, Arg 103, Gln 104, Thr 105, Thr 107, Gln 108, His 118, Trp 119, Glu 120, Glu 122, Leu 123, Gly 124, Lys 137, Arg 156, Gly 157, Met 158, Ser 231, Asp 232, Ile 233, Ser 234, Leu 235, Val 236, Asp 237, Tyr 238, Thr 239, Lys 240, and Lys 243.

Aspects of the disclosure relate to TL1A binding antibody that binds specifically to a TL1A polypeptide comprising SEQ ID NO: 2493 at any one of amino acid residues Val 102, Arg 103, Gln 104, Thr 105, Thr 107, Gln 108, His 118, Trp 119, Glu 120, Glu 122, Leu 123, Gly 124, Lys 137, Arg 156, Gly 157, Met 158, Ser 234, Tyr 238, and Thr 239. In some embodiments, the TL1A binding antibody specifically binds to the TL1A sequences at amino acid residues Val 102, Arg 103, Gln 104, Thr 105, Thr 107, Gln 108, His 118, Trp 119, Glu 120, Glu 122, Leu 123, Gly 124, Lys 137, Arg 156, Gly 157, Met 158, Ser 234, Tyr 238, and Thr 239.

Aspects of the disclosure relate to a TL1A binding protein comprising: a) a heavy chain variable region (VH) comprising (i) a CDR1 having an amino acid sequence according to any one of SEQ ID NOs: 5-10, or having an amino acid sequence with one or two amino acid substitution as compared to any one of SEQ ID NOs: 5-10, (ii) a CDR2 having an amino acid sequence according to any one of SEQ ID NOs: 15-20, or having an amino acid sequence with one or two amino acid substitution as compared to any one of SEQ ID NOs: 15-20, and (iii) a CDR3 having an amino acid sequence according to any one of SEQ ID NOs: 25-30, or having an amino acid sequence with one or two amino acid substitution as compared to any one of SEQ ID NOs: 25-30; and b) a light chain variable region (VL) comprising (i) a CDR1 having an amino acid sequence according to any one of SEQ ID NOs: 35-40, or having an amino acid sequence with one or two amino acid substitution as compared to any one of SEQ ID NOs: 35-40, (ii) a CDR2 having an amino acid sequence according to any one of SEQ ID NOs: 45-50, or having an amino acid sequence with one or two amino acid substitution as compared to any one of SEQ ID NOs: 45-50, and (iii) a CDR3 having an amino acid sequence according to any one of SEQ ID NOs: 55-60, or having an amino acid sequence with one or two amino acid substitution as compared to any one of SEQ ID NOs: 55-60.

In some embodiments, the TL1A binding protein comprises a VH comprising a sequence having at least 80% sequence identity to the amino acid sequence of any one of SEQ ID NOs: 185-190 and a VL comprising a sequence having at least 80% sequence identity to the amino acid sequence of any one of SEQ ID NOs: 195-200.

In some embodiments, the VH comprises a sequence having at least 80% sequence identity to the amino acid sequence of SEQ ID NO: 185 and the VL comprises a sequence having at least 80% sequence identity to the amino acid sequence of SEQ ID NO: 195.

In some embodiments, the VH comprises a sequence having at least 80% sequence identity to the amino acid sequence of SEQ ID NO: 186 and the VL comprises a sequence having at least 80% sequence identity to the amino acid sequence of SEQ ID NO: 196.

In some embodiments, the VH comprises a sequence having at least 80% sequence identity to the amino acid sequence of SEQ ID NO: 187 and the VL comprises a sequence having at least 80% sequence identity to the amino acid sequence of SEQ ID NO: 197.

In some embodiments, the VH comprises a sequence having at least 80% sequence identity to the amino acid sequence of SEQ ID NO: 188 and the VL comprises a sequence having at least 80% sequence identity to the amino acid sequence of SEQ ID NO: 198.

In some embodiments, the VH comprises a sequence having at least 80% sequence identity to the amino acid sequence of SEQ ID NO: 189 and the VL comprises a sequence having at least 80% sequence identity to the amino acid sequence of SEQ ID NO: 199.

In some embodiments, the VH comprises a sequence having at least 80% sequence identity to the amino acid sequence of SEQ ID NO: 190 and the VL comprises a sequence having at least 80% sequence identity to the amino acid sequence of SEQ ID NO: 200.

Described herein is a TL1A binding protein, wherein the TL1A binding protein comprises a) a heavy chain variable region (VH) comprising (i) a CDR1 having an amino acid sequence according to SEQ ID NO: 5, or a CDR1 having one to two amino acid substitutions as compared to the sequence of SEQ ID NO: 5, (ii) a CDR2 having an amino acid sequence according to SEQ ID NO: 15, or a CDR2 having one to two amino acid substitutions as compared to the sequence of SEQ ID NO: 15, and (iii) a CDR3 having an amino acid sequence according to SEQ ID NO: 25, or a CDR3 having one to two amino acid substitutions as compared to the sequence of SEQ ID NO: 25; and b) a light chain variable region (VL) comprising (i) a CDR1 having an amino acid sequence according to SEQ ID NO: 35, or a CDR1 having one to two amino acid substitutions as compared to the sequence of SEQ ID NO: 35, (ii) a CDR2 having an amino acid sequence according to SEQ ID NO: 45, or a CDR2 having one to two amino acid substitutions as compared to the sequence of SEQ ID NO: 45, and (iii) a CDR3 having an amino acid sequence according to SEQ ID NO: 55, or a CDR3 having one to two amino acid substitutions as compared to the sequence of SEQ ID NO: 55. In some embodiments, the TL1A binding protein comprises a) a heavy chain variable region (VH) comprising (i) a CDR1 having an amino acid sequence according to SEQ ID NO: 5, (ii) a CDR2 having an amino acid sequence according to SEQ ID NO: 15, and (iii) a CDR3 having an amino acid sequence according to SEQ ID NO: 25; and b) a light chain variable region (VL) comprising (i) a CDR1 having an amino acid sequence according to SEQ ID NO: 35, (ii) a CDR2 having an amino acid sequence according to SEQ ID NO: 45, and (iii) a CDR3 having an amino acid sequence according to SEQ ID NO: 55. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 6, or a CDR1 having one to two amino acid substitutions as compared to the sequence of SEQ ID NO: 6, (ii) a CDR2 having an amino acid sequence according to SEQ ID NO: 16, or a CDR2 having one to two amino acid substitutions as compared to the sequence of SEQ ID NO: 16, and (iii) a CDR3 having an amino acid sequence according to SEQ ID NO: 26, or a CDR3 having one to two amino acid substitutions as compared to the sequence of SEQ ID NO: 26; and b) a light chain variable region (VL) comprising (i) a CDR1 having an amino acid sequence according to SEQ ID NO: 36, or a CDR1 having one to two amino acid substitutions as compared to the sequence of SEQ ID NO: 36, (ii) a CDR2 having an amino acid sequence according to SEQ ID NO: 46, or a CDR2 having one to two amino acid substitutions as compared to the sequence of SEQ ID NO: 46, and (iii) a CDR3 having an amino acid sequence according to SEQ ID NO: 56, or a CDR3 having one to two amino acid substitutions as compared to the sequence of SEQ ID NO: 56. In some embodiments, the TL1A binding protein comprises a) a heavy chain variable region (VH) comprising (i) a CDR1 having an amino acid sequence according to SEQ ID NO: 6, (ii) a CDR2 having an amino acid sequence according to SEQ ID NO: 16, and (iii) a CDR3 having an amino acid sequence according to SEQ ID NO: 26; and b) a light chain variable region (VL) comprising (i) a CDR1 having an amino acid sequence according to SEQ ID NO: 36, (ii) a CDR2 having an amino acid sequence according to SEQ ID NO: 46, and (iii) a CDR3 having an amino acid sequence according to SEQ ID NO: 56. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 7, or a CDR1 having one to two amino acid substitutions as compared to the sequence of SEQ ID NO: 7, (ii) a CDR2 having an amino acid sequence according to SEQ ID NO: 17, or a CDR2 having one to two amino acid substitutions as compared to the sequence of SEQ ID NO: 17, and (iii) a CDR3 having an amino acid sequence according to SEQ ID NO: 27, or a CDR3 having one to two amino acid substitutions as compared to the sequence of SEQ ID NO: 27; and b) a light chain variable region (VL) comprising (i) a CDR1 having an amino acid sequence according to SEQ ID NO: 37, or a CDR1 having one to two amino acid substitutions as compared to the sequence of SEQ ID NO: 37, (ii) a CDR2 having an amino acid sequence according to SEQ ID NO: 47, or a CDR2 having one to two amino acid substitutions as compared to the sequence of SEQ ID NO: 47, and (iii) a CDR3 having an amino acid sequence according to SEQ ID NO: 57, or a CDR3 having one to two amino acid substitutions as compared to the sequence of SEQ ID NO: 57. In some embodiments, the TL1A binding protein comprises a) a heavy chain variable region (VH) comprising (i) a CDR1 having an amino acid sequence according to SEQ ID NO: 7, (ii) a CDR2 having an amino acid sequence according to SEQ ID NO: 17, and (iii) a CDR3 having an amino acid sequence according to SEQ ID NO: 27; and b) a light chain variable region (VL) comprising (i) a CDR1 having an amino acid sequence according to SEQ ID NO: 37, (ii) a CDR2 having an amino acid sequence according to SEQ ID NO: 47, and (iii) a CDR3 having an amino acid sequence according to SEQ ID NO: 57. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 8, or a CDR1 having one to two amino acid substitutions as compared to the sequence of SEQ ID NO: 8, (ii) a CDR2 having an amino acid sequence according to SEQ ID NO: 18, or a CDR2 having one to two amino acid substitutions as compared to the sequence of SEQ ID NO: 18, and (iii) a CDR3 having an amino acid sequence according to SEQ ID NO: 28, or a CDR3 having one to two amino acid substitutions as compared to the sequence of SEQ ID NO: 28; and b) a light chain variable region (VL) comprising (i) a CDR1 having an amino acid sequence according to SEQ ID NO: 38, or a CDR1 having one to two amino acid substitutions as compared to the sequence of SEQ ID NO: 38, (ii) a CDR2 having an amino acid sequence according to SEQ ID NO: 48, or a CDR2 having one to two amino acid substitutions as compared to the sequence of SEQ ID NO: 48, and (iii) a CDR3 having an amino acid sequence according to SEQ ID NO: 58, or a CDR3 having one to two amino acid substitutions as compared to the sequence of SEQ ID NO: 58. In some embodiments, the TL1A binding protein comprises a) a heavy chain variable region (VH) comprising (i) a CDR1 having an amino acid sequence according to SEQ ID NO: 8, (ii) a CDR2 having an amino acid sequence according to SEQ ID NO: 18, and (iii) a CDR3 having an amino acid sequence according to SEQ ID NO: 28; and b) a light chain variable region (VL) comprising (i) a CDR1 having an amino acid sequence according to SEQ ID NO: 38, (ii) a CDR2 having an amino acid sequence according to SEQ ID NO: 48, and (iii) a CDR3 having an amino acid sequence according to SEQ ID NO: 58. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 9, or a CDR1 having one to two amino acid substitutions as compared to the sequence of SEQ ID NO: 9, (ii) a CDR2 having an amino acid sequence according to SEQ ID NO: 19, or a CDR2 having one to two amino acid substitutions as compared to the sequence of SEQ ID NO: 19, and (iii) a CDR3 having an amino acid sequence according to SEQ ID NO: 29, or a CDR3 having one to two amino acid substitutions as compared to the sequence of SEQ ID NO: 29; and b) a light chain variable region (VL) comprising (i) a CDR1 having an amino acid sequence according to SEQ ID NO: 39, or a CDR1 having one to two amino acid substitutions as compared to the sequence of SEQ ID NO: 39, (ii) a CDR2 having an amino acid sequence according to SEQ ID NO: 49, or a CDR2 having one to two amino acid substitutions as compared to the sequence of SEQ ID NO: 49, and (iii) a CDR3 having an amino acid sequence according to SEQ ID NO: 59, or a CDR3 having one to two amino acid substitutions as compared to the sequence of SEQ ID NO: 59. In some embodiments, the TL1A binding protein comprises a) a heavy chain variable region (VH) comprising (i) a CDR1 having an amino acid sequence according to SEQ ID NO: 9, (ii) a CDR2 having an amino acid sequence according to SEQ ID NO: 19, and (iii) a CDR3 having an amino acid sequence according to SEQ ID NO: 29; and a light chain variable region (VL) comprising (i) a CDR1 having an amino acid sequence according to SEQ ID NO: 39, (ii) a CDR2 having an amino acid sequence according to SEQ ID NO: 49, and (iii) a CDR3 having an amino acid sequence according to SEQ ID NO: 59. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 10, or a CDR1 having one to two amino acid substitutions as compared to the sequence of SEQ ID NO: 10, (ii) a CDR2 having an amino acid sequence according to SEQ ID NO: 20, or a CDR2 having one to two amino acid substitutions as compared to the sequence of SEQ ID NO: 20, and (iii) a CDR3 having an amino acid sequence according to SEQ ID NO: 30, or a CDR3 having one to two amino acid substitutions as compared to the sequence of SEQ ID NO: 30; and b) a light chain variable region (VL) comprising (i) a CDR1 having an amino acid sequence according to SEQ ID NO: 40, or a CDR1 having one to two amino acid substitutions as compared to the sequence of SEQ ID NO: 40, (ii) a CDR2 having an amino acid sequence according to SEQ ID NO: 50, or a CDR2 having one to two amino acid substitutions as compared to the sequence of SEQ ID NO: 50, and (iii) a CDR3 having an amino acid sequence according to SEQ ID NO: 60, or a CDR3 having one to two amino acid substitutions as compared to the sequence of SEQ ID NO: 60. In some embodiments, the TL1A binding protein comprises a) a heavy chain variable region (VH) comprising (i) a CDR1 having an amino acid sequence according to SEQ ID NO: 10, (ii) a CDR2 having an amino acid sequence according to SEQ ID NO: 20, and (iii) a CDR3 having an amino acid sequence according to SEQ ID NO: 30; and a light chain variable region (VL) comprising (i) a CDR1 having an amino acid sequence according to SEQ ID NO: 40, (ii) a CDR2 having an amino acid sequence according to SEQ ID NO: 50, and (iii) a CDR3 having an amino acid sequence according to SEQ ID NO: 60. In some embodiments, the TL1A binding protein comprises an immunoglobin Fc domain. In some embodiments, the Fc domain comprises amino acid modifications L234A/L235A (LALA) and/or M252Y, S254T, and T256E (YTE). In some embodiments, the TL1A binding protein or the TL1A binding antibody, wherein the TL1A binding protein binds TL1A with a Ko less than about 0.5 nanomolar (nM).

Described herein is a TL1A binding protein comprising a heavy chain variable region (VH) comprising (i) a CDR1 having an amino acid sequence according to any one of SEQ ID NOs: 5-10, or having an amino acid sequence with one or two amino acid substitution as compared to any one of SEQ ID NOs: 5-10; (ii) a CDR2 having an amino acid sequence according to any one of SEQ ID NOs: 15-20, or having an amino acid sequence with one or two amino acid substitution as compared to any one of SEQ ID NOs: 15-20; and (ii) a CDR3 having an amino acid sequence according to any one of SEQ ID NOs: 25-30, or having an amino acid sequence with one or two amino acid substitution as compared to any one of SEQ ID NOs: 25-30.

Described herein is a TL1A binding protein TL1A binding protein comprising a light chain variable region (VL) comprising (i) a CDR1 having an amino acid sequence according to any one of SEQ ID NOs: 35-40, or having an amino acid sequence with one or two amino acid substitution as compared to any one of SEQ ID NOs: 35-40: (i) a CDR2 having an amino acid sequence according to any one of SEQ ID NOs: 45-50, or having an amino acid sequence with one or two amino acid substitution as compared to any one of SEQ ID NOs: 45-50; and (iii) a CDR3 having an amino acid sequence according to any one of SEQ ID NOs: 55-60, or having an amino acid sequence with one or two amino acid substitution as compared to any one of SEQ ID NOs: 55-60.

Described herein is a method to obtain an antibody that specifically binds to a certain epitope portion of a TL1A sequence comprising SEQ ID NO: 2493, wherein the method comprises assessing whether an antibody binds specifically to the certain epitope portion, wherein the certain epitope portion has amino acid residues Val 102, Arg 103, Gln 104, Thr 105, Thr 107, Gln 108, His 118, Trp 119, Glu 120, Glu 122, Leu 123, Gly 124, Lys 137, Arg 156, Gly 157, Met 158, Ser 227, Tyr 231, and Thr 232 of SEQ ID NO: 2493, and isolating or selecting the an antibody that binds to the certain epitope portion.

Also, described herein are TL1A binding proteins that specifically binds to a TL1A polypeptide comprising SEQ ID NO: 2493 or 2494, wherein the TL1A binding protein is an antibody.

Described herein are TL1A binding proteins comprising: a) a heavy chain variable region (VH) comprising (i) a CDR1 having an amino acid sequence according to any one of SEQ ID NOs: 1-4 and 313-421, or having an amino acid sequence with one or two amino acid substitution as compared to any one of SEQ ID NOs: 1-4 and 313-421, (ii) a CDR2 having an amino acid sequence according to any one of SEQ ID NOs: 11-14 and 422-530, or having an amino acid sequence with one or two amino acid substitution as compared to any one of to any one of SEQ ID NOs: 11-14 and 422-530, and (iii) a CDR3 having an amino acid sequence according to any one of SEQ ID NOs: 21-24 and 531-639, or having an amino acid sequence with one or two amino acid substitution as compared to any one of to any one of SEQ ID NOS: 21-24 and 531-639; and b) a light chain variable region (VL) comprising (i) a CDR1 having an amino acid sequence according to any one of SEQ ID NOs: 31-34 and 640-748, or having an amino acid sequence with one or two amino acid substitution as compared to any one of SEQ ID NOs: 31-34 and 640-748, (ii) a CDR2 having an amino acid sequence according to any one of SEQ ID NOs: 41-44 and 749-857, or having an amino acid sequence with one or two amino acid substitution as compared to any one of SEQ ID NOs: 41-44 and 749-857, and (iii) a CDR3 having an amino acid sequence according to any one of SEQ ID NOs: 51-54 and 858-966, or having an amino acid sequence with one or two amino acid substitution as compared to any one of SEQ ID NOs: 51-54 and 858-966.

In some embodiments, the VH comprises a sequence having at least 80% sequence identity to the amino acid sequence of any one of SEQ ID NOs: 181-184 and 2275-2383 and the VL comprises a sequence having at least 80% sequence identity to the amino acid sequence of any one of SEQ ID NOs: 191-194 and 2384-2492.

In some embodiments, the VH comprises a sequence having at least 80% sequence identity to the amino acid sequence of SEQ ID NO: 181 and the VL comprises a sequence having at least 80% sequence identity to the amino acid sequence of SEQ ID NO: 191.

In some embodiments, the VH comprises a sequence having at least 80% sequence identity to the amino acid sequence of SEQ ID NO: 182 and the VL comprises a sequence having at least 80% sequence identity to the amino acid sequence of SEQ ID NO: 192.

In some embodiments, the VH comprises a sequence having at least 80% sequence identity to the amino acid sequence of SEQ ID NO: 183 and the VL comprises a sequence having at least 80% sequence identity to the amino acid sequence of SEQ ID NO: 193.

In some embodiments, the VH comprises a sequence having at least 80% sequence identity to the amino acid sequence of SEQ ID NO: 184 and the VL comprises a sequence having at least 80% sequence identity to the amino acid sequence of SEQ ID NO: 194.

In some embodiments, the VH comprises a sequence having at least 80% sequence identity to the amino acid sequence of SEQ ID NO: 2283 and the VL comprises a sequence having at least 80% sequence identity to the amino acid sequence of SEQ ID NO: 2392.

In some embodiments, the VH comprises a sequence having at least 80% sequence identity to the amino acid sequence of SEQ ID NO: 2303 and the VL comprises a sequence having at least 80% sequence identity to the amino acid sequence of SEQ ID NO: 2412.

In some embodiments, the VH comprises a sequence having at least 80% sequence identity to the amino acid sequence of SEQ ID NO: 2307 and the VL comprises a sequence having at least 80% sequence identity to the amino acid sequence of SEQ ID NO: 2416.

In some embodiments, the VH comprises a sequence having at least 80% sequence identity to the amino acid sequence of SEQ ID NO: 2311 and the VL comprises a sequence having at least 80% sequence identity to the amino acid sequence of SEQ ID NO: 2420.

In some embodiments, the VH comprises a sequence having at least 80% sequence identity to the amino acid sequence of SEQ ID NO: 2313 and the VL comprises a sequence having at least 80% sequence identity to the amino acid sequence of SEQ ID NO: 2422.

In some embodiments, the VH comprises a sequence having at least 80% sequence identity to the amino acid sequence of SEQ ID NO: 2316 and the VL comprises a sequence having at least 80% sequence identity to the amino acid sequence of SEQ ID NO: 2425.

In some embodiments, the VH comprises a sequence having at least 80% sequence identity to the amino acid sequence of SEQ ID NO: 2327 and the VL comprises a sequence having at least 80% sequence identity to the amino acid sequence of SEQ ID NO: 2436.

In some embodiments, the VH comprises a sequence having at least 80% sequence identity to the amino acid sequence of SEQ ID NO: 2333 and the VL comprises a sequence having at least 80% sequence identity to the amino acid sequence of SEQ ID NO: 2442.

In some embodiments, the VH comprises a sequence having at least 80% sequence identity to the amino acid sequence of SEQ ID NO: 2334 and the VL comprises a sequence having at least 80% sequence identity to the amino acid sequence of SEQ ID NO: 2443.

In some embodiments, the VH comprises a sequence having at least 80% sequence identity to the amino acid sequence of SEQ ID NO: 2335 and the VL comprises a sequence having at least 80% sequence identity to the amino acid sequence of SEQ ID NO: 2444.

In some embodiments, the VH comprises a sequence having at least 80% sequence identity to the amino acid sequence of SEQ ID NO: 2350 and the VL comprises a sequence having at least 80% sequence identity to the amino acid sequence of SEQ ID NO: 2459.

In some embodiments, the VH comprises a sequence having at least 80% sequence identity to the amino acid sequence of SEQ ID NO: 2356 and the VL comprises a sequence having at least 80% sequence identity to the amino acid sequence of SEQ ID NO: 2465.

In some embodiments, the VH comprises a sequence having at least 80% sequence identity to the amino acid sequence of SEQ ID NO: 2362 and the VL comprises a sequence having at least 80% sequence to SEQ ID NO: 2471.

Described herein is a TL1A binding protein, wherein the TL1A binding protein comprises a) a heavy chain variable region (VH) comprising (i) a CDR1 having an amino acid sequence according to SEQ ID NO: 1, or a CDR1 having one to two amino acid substitutions as compared to the sequence of SEQ ID NO: 1, (ii) a CDR2 having an amino acid sequence according to SEQ ID NO: 11, or a CDR2 having one to two amino acid substitutions as compared to the sequence of SEQ ID NO: 11, and (iii) a CDR3 having an amino acid sequence according to SEQ ID NO: 21, or a CDR3 having one to two amino acid substitutions as compared to the sequence of SEQ ID NO: 21; and b) a light chain variable region (VL) comprising (i) a CDR1 having an amino acid sequence according to SEQ ID NO: 31, or a CDR1 having one to two amino acid substitutions as compared to the sequence of SEQ ID NO: 31, (ii) a CDR2 having an amino acid sequence according to SEQ ID NO: 41, or a CDR2 having one to two amino acid substitutions as compared to the sequence of SEQ ID NO: 41, and (iii) a CDR3 having an amino acid sequence according to SEQ ID NO: 51, or a CDR3 having one to two amino acid substitutions as compared to the sequence of SEQ ID NO: 51. In some embodiments, the TL1A binding protein comprises a) a heavy chain variable region (VH) comprising (i) a CDR1 having an amino acid sequence according to SEQ ID NO: 1, (ii) a CDR2 having an amino acid sequence according to SEQ ID NO: 11, and (iii) a CDR3 having an amino acid sequence according to SEQ ID NO: 21; and b) a light chain variable region (VL) comprising (i) a CDR1 having an amino acid sequence according to SEQ ID NO: 31, (ii) a CDR2 having an amino acid sequence according to SEQ ID NO: 41, and (iii) a CDR3 having an amino acid sequence according to SEQ ID NO: 51. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 2, or a CDR1 having one to two amino acid substitutions as compared to the sequence of SEQ ID NO: 2, (ii) a CDR2 having an amino acid sequence according to SEQ ID NO: 12, or a CDR2 having one to two amino acid substitutions as compared to the sequence of SEQ ID NO: 12, and (iii) a CDR3 having an amino acid sequence according to SEQ ID NO: 22, or a CDR3 having one to two amino acid substitutions as compared to the sequence of SEQ ID NO: 22; and a light chain variable region (VL) comprising (i) a CDR1 having an amino acid sequence according to SEQ ID NO: 32, or a CDR1 having one to two amino acid substitutions as compared to the sequence of SEQ ID NO: 32, (ii) a CDR2 having an amino acid sequence according to SEQ ID NO: 42, or a CDR2 having one to two amino acid substitutions as compared to the sequence of SEQ ID NO: 42, and (iii) a CDR3 having an amino acid sequence according to SEQ ID NO: 52, or a CDR3 having one to two amino acid substitutions as compared to the sequence of SEQ ID NO: 52. In some embodiments, the TL1A binding protein comprises a) a heavy chain variable region (VH) comprising (i) a CDR1 having an amino acid sequence according to SEQ ID NO: 2, (ii) a CDR2 having an amino acid sequence according to SEQ ID NO: 12, and (iii) a CDR3 having an amino acid sequence according to SEQ ID NO: 22; and b) a light chain variable region (VL) comprising (i) a CDR1 having an amino acid sequence according to SEQ ID NO: 32, (ii) a CDR2 having an amino acid sequence according to SEQ ID NO: 42, and (iii) a CDR3 having an amino acid sequence according to SEQ ID NO: 52. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 3, or a CDR1 having one to two amino acid substitutions as compared to the sequence of SEQ ID NO: 3, (ii) a CDR2 having an amino acid sequence according to SEQ ID NO: 13, or a CDR2 having one to two amino acid substitutions as compared to the sequence of SEQ ID NO: 13, and (iii) a CDR3 having an amino acid sequence according to SEQ ID NO: 23, or a CDR3 having one to two amino acid substitutions as compared to the sequence of SEQ ID NO: 23; and b) a light chain variable region (VL) comprising (i) a CDR1 having an amino acid sequence according to SEQ ID NO: 33, or a CDR1 having one to two amino acid substitutions as compared to the sequence of SEQ ID NO: 33, (ii) a CDR2 having an amino acid sequence according to SEQ ID NO: 43, or a CDR2 having one to two amino acid substitutions as compared to the sequence of SEQ ID NO: 43, and (iii) a CDR3 having an amino acid sequence according to SEQ ID NO: 53, or a CDR3 having one to two amino acid substitutions as compared to the sequence of SEQ ID NO: 53. In some embodiments, the TL1A binding protein comprises a) a heavy chain variable region (VH) comprising (i) a CDR1 having an amino acid sequence according to SEQ ID NO: 3, (ii) a CDR2 having an amino acid sequence according to SEQ ID NO: 13, and (iii) a CDR3 having an amino acid sequence according to SEQ ID NO: 23; and b) a light chain variable region (VL) comprising (i) a CDR1 having an amino acid sequence according to SEQ ID NO: 33, (ii) a CDR2 having an amino acid sequence according to SEQ ID NO: 43, and (iii) a CDR3 having an amino acid sequence according to SEQ ID NO: 53. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 4, or a CDR1 having one to two amino acid substitutions as compared to the sequence of SEQ ID NO: 4, (ii) a CDR2 having an amino acid sequence according to SEQ ID NO: 14, or a CDR2 having one to two amino acid substitutions as compared to the sequence of SEQ ID NO: 14, and (iii) a CDR3 having an amino acid sequence according to SEQ ID NO: 24, or a CDR3 having one to two amino acid substitutions as compared to the sequence of SEQ ID NO: 24; and a light chain variable region (VL) comprising (i) a CDR1 having an amino acid sequence according to SEQ ID NO: 34, or a CDR1 having one to two amino acid substitutions as compared to the sequence of SEQ ID NO: 34, (ii) a CDR2 having an amino acid sequence according to SEQ ID NO: 44, or a CDR2 having one to two amino acid substitutions as compared to the sequence of SEQ ID NO: 44, and (iii) a CDR3 having an amino acid sequence according to SEQ ID NO: 54, or a CDR3 having one to two amino acid substitutions as compared to the sequence of SEQ ID NO: 54. In some embodiments, the TL1A binding protein comprises a) a heavy chain variable region (VH) comprising (i) a CDR1 having an amino acid sequence according to SEQ ID NO: 4, (ii) a CDR2 having an amino acid sequence according to SEQ ID NO: 14, and (iii) a CDR3 having an amino acid sequence according to SEQ ID NO: 24; and b) a light chain variable region (VL) comprising (i) a CDR1 having an amino acid sequence according to SEQ ID NO: 34, (ii) a CDR2 having an amino acid sequence according to SEQ ID NO: 44, and (iii) a CDR3 having an amino acid sequence according to SEQ ID NO: 54. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 321, or a CDR1 having one to two amino acid substitutions as compared to the sequence of SEQ ID NO: 321, (ii) a CDR2 having an amino acid sequence according to SEQ ID NO: 430, or a CDR2 having one to two amino acid substitutions as compared to the sequence of SEQ ID NO: 430, and (iii) a CDR3 having an amino acid sequence according to SEQ ID NO: 539, or a CDR3 having one to two amino acid substitutions as compared to the sequence of SEQ ID NO: 539; and a light chain variable region (VL) comprising (i) a CDR1 having an amino acid sequence according to SEQ ID NO: 648, or a CDR1 having one to two amino acid substitutions as compared to the sequence of SEQ ID NO: 648, (ii) a CDR2 having an amino acid sequence according to SEQ ID NO: 757, or a CDR2 having one to two amino acid substitutions as compared to the sequence of SEQ ID NO: 757, and (iii) a CDR3 having an amino acid sequence according to SEQ ID NO: 866, or a CDR3 having one to two amino acid substitutions as compared to the sequence of SEQ ID NO: 866. In some embodiments, the TL1A binding protein comprises a) a heavy chain variable region (VH) comprising (i) a CDR1 having an amino acid sequence according to SEQ ID NO: 321, (ii) a CDR2 having an amino acid sequence according to SEQ ID NO: 430, and (iii) a CDR3 having an amino acid sequence according to SEQ ID NO: 539; and b) a light chain variable region (VL) comprising (i) a CDR1 having an amino acid sequence according to SEQ ID NO: 648, (ii) a CDR2 having an amino acid sequence according to SEQ ID NO: 757, and (iii) a CDR3 having an amino acid sequence according to SEQ ID NO: 866. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 341, or a CDR1 having one to two amino acid substitutions as compared to the sequence of SEQ ID NO: 341, (ii) a CDR2 having an amino acid sequence according to SEQ ID NO: 450, or a CDR2 having one to two amino acid substitutions as compared to the sequence of SEQ ID NO: 450, and (iii) a CDR3 having an amino acid sequence according to SEQ ID NO: 559, or a CDR3 having one to two amino acid substitutions as compared to the sequence of SEQ ID NO: 559; and b) a light chain variable region (VL) comprising (i) a CDR1 having an amino acid sequence according to SEQ ID NO: 668, or a CDR1 having one to two amino acid substitutions as compared to the sequence of SEQ ID NO: 668, (ii) a CDR2 having an amino acid sequence according to SEQ ID NO: 777, or a CDR2 having one to two amino acid substitutions as compared to the sequence of SEQ ID NO: 777, and (iii) a CDR3 having an amino acid sequence according to SEQ ID NO: 886, or a CDR3 having one to two amino acid substitutions as compared to the sequence of SEQ ID NO: 886. In some embodiments, the TL1A binding protein comprises a) a heavy chain variable region (VH) comprising (i) a CDR1 having an amino acid sequence according to SEQ ID NO: 341, (ii) a CDR2 having an amino acid sequence according to SEQ ID NO: 450, and (iii) a CDR3 having an amino acid sequence according to SEQ ID NO: 559; and b) a light chain variable region (VL) comprising (i) a CDR1 having an amino acid sequence according to SEQ ID NO: 668, (ii) a CDR2 having an amino acid sequence according to SEQ ID NO: 777, and (iii) a CDR3 having an amino acid sequence according to SEQ ID NO: 886. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 345, or a CDR1 having one to two amino acid substitutions as compared to the sequence of SEQ ID NO: 345, (ii) a CDR2 having an amino acid sequence according to SEQ ID NO: 454, or a CDR2 having one to two amino acid substitutions as compared to the sequence of SEQ ID NO: 454, and (iii) a CDR3 having an amino acid sequence according to SEQ ID NO: 563, or a CDR3 having one to two amino acid substitutions as compared to the sequence of SEQ ID NO: 563; and b) a light chain variable region (VL) comprising (i) a CDR1 having an amino acid sequence according to SEQ ID NO: 672, or a CDR1 having one to two amino acid substitutions as compared to the sequence of SEQ ID NO: 672, (ii) a CDR2 having an amino acid sequence according to SEQ ID NO: 781, or a CDR2 having one to two amino acid substitutions as compared to the sequence of SEQ ID NO: 781, and (iii) a CDR3 having an amino acid sequence according to SEQ ID NO: 890, or a CDR3 having one to two amino acid substitutions as compared to the sequence of SEQ ID NO: 890. In some embodiments, the TL1A binding protein comprises a) a heavy chain variable region (VH) comprising (i) a CDR1 having an amino acid sequence according to SEQ ID NO: 345, (ii) a CDR2 having an amino acid sequence according to SEQ ID NO: 454, and (iii) a CDR3 having an amino acid sequence according to SEQ ID NO: 563; and b) a light chain variable region (VL) comprising (i) a CDR1 having an amino acid sequence according to SEQ ID NO: 672, (ii) a CDR2 having an amino acid sequence according to SEQ ID NO: 781, and (iii) a CDR3 having an amino acid sequence according to SEQ ID NO: 890. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 349, or a CDR1 having one to two amino acid substitutions as compared to the sequence of SEQ ID NO: 349, (ii) a CDR2 having an amino acid sequence according to SEQ ID NO: 458, or a CDR2 having one to two amino acid substitutions as compared to the sequence of SEQ ID NO: 458, and (iii) a CDR3 having an amino acid sequence according to SEQ ID NO: 567, or a CDR3 having one to two amino acid substitutions as compared to the sequence of SEQ ID NO: 567; and b) a light chain variable region (VL) comprising (i) a CDR1 having an amino acid sequence according to SEQ ID NO: 676, or a CDR1 having one to two amino acid substitutions as compared to the sequence of SEQ ID NO: 676, (ii) a CDR2 having an amino acid sequence according to SEQ ID NO: 785, or a CDR2 having one to two amino acid substitutions as compared to the sequence of SEQ ID NO: 785, and (iii) a CDR3 having an amino acid sequence according to SEQ ID NO: 894, or a CDR3 having one to two amino acid substitutions as compared to the sequence of SEQ ID NO: 894. In some embodiments, the TL1A binding protein comprises a) a heavy chain variable region (VH) comprising (i) a CDR1 having an amino acid sequence according to SEQ ID NO: 349, (ii) a CDR2 having an amino acid sequence according to SEQ ID NO: 458, and (iii) a CDR3 having an amino acid sequence according to SEQ ID NO: 567; and b) a light chain variable region (VL) comprising (i) a CDR1 having an amino acid sequence according to SEQ ID NO: 676, (ii) a CDR2 having an amino acid sequence according to SEQ ID NO: 785, and (iii) a CDR3 having an amino acid sequence according to SEQ ID NO: 894. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 351, or a CDR1 having one to two amino acid substitutions as compared to the sequence of SEQ ID NO: 351, (ii) a CDR2 having an amino acid sequence according to SEQ ID NO: 460, or a CDR2 having one to two amino acid substitutions as compared to the sequence of SEQ ID NO: 460; and (iii) a CDR3 having an amino acid sequence according to SEQ ID NO: 569, or a CDR3 having one to two amino acid substitutions as compared to the sequence of SEQ ID NO: 569; and b) a light chain variable region (VL) comprising (i) a CDR1 having an amino acid sequence according to SEQ ID NO: 678, or a CDR1 having one to two amino acid substitutions as compared to the sequence of SEQ ID NO: 678, (ii) a CDR2 having an amino acid sequence according to SEQ ID NO: 787, or a CDR2 having one to two amino acid substitutions as compared to the sequence of SEQ ID NO: 787; and (iii) a CDR3 having an amino acid sequence according to SEQ ID NO: 896, or a CDR3 having one to two amino acid substitutions as compared to the sequence of SEQ ID NO: 896. In some embodiments, the TL1A binding protein comprises a) a heavy chain variable region (VH) comprising (i) a CDR1 having an amino acid sequence according to SEQ ID NO: 351, (ii) a CDR2 having an amino acid sequence according to SEQ ID NO: 460; and (iii) a CDR3 having an amino acid sequence according to SEQ ID NO: 569; and b) a light chain variable region (VL) comprising (i) a CDR1 having an amino acid sequence according to SEQ ID NO: 678, (ii) a CDR2 having an amino acid sequence according to SEQ ID NO: 787; and (iii) a CDR3 having an amino acid sequence according to SEQ ID NO: 896. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 354, or a CDR1 having one to two amino acid substitutions as compared to the sequence of SEQ ID NO: 354, (ii) a CDR2 having an amino acid sequence according to SEQ ID NO: 463, or a CDR2 having one to two amino acid substitutions as compared to the sequence of SEQ ID NO: 463, and (iii) a CDR3 having an amino acid sequence according to SEQ ID NO: 572, or a CDR3 having one to two amino acid substitutions as compared to the sequence of SEQ ID NO: 572; and b) a light chain variable region (VL) comprising (i) a CDR1 having an amino acid sequence according to SEQ ID NO: 681, or a CDR1 having one to two amino acid substitutions as compared to the sequence of SEQ ID NO: 681, (ii) a CDR2 having an amino acid sequence according to SEQ ID NO: 790, or a CDR2 having one to two amino acid substitutions as compared to the sequence of SEQ ID NO: 790, and (iii) a CDR3 having an amino acid sequence according to SEQ ID NO: 899, or a CDR3 having one to two amino acid substitutions as compared to the sequence of SEQ ID NO: 899. In some embodiments, the TL1A binding protein comprises a) a heavy chain variable region (VH) comprising (i) a CDR1 having an amino acid sequence according to SEQ ID NO: 354, (ii) a CDR2 having an amino acid sequence according to SEQ ID NO: 463, and (iii) a CDR3 having an amino acid sequence according to SEQ ID NO: 572; and b) a light chain variable region (VL) comprising (i) a CDR1 having an amino acid sequence according to SEQ ID NO: 681, (ii) a CDR2 having an amino acid sequence according to SEQ ID NO: 790, and (iii) a CDR3 having an amino acid sequence according to SEQ ID NO: 899. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 365, or a CDR1 having one to two amino acid substitutions as compared to the sequence of SEQ ID NO: 365, (ii) a CDR2 having an amino acid sequence according to SEQ ID NO: 474, or a CDR2 having one to two amino acid substitutions as compared to the sequence of SEQ ID NO: 474, and (iii) a CDR3 having an amino acid sequence according to SEQ ID NO: 583, or a CDR3 having one to two amino acid substitutions as compared to the sequence of SEQ ID NO: 583; and a light chain variable region (VL) comprising (i) a CDR1 having an amino acid sequence according to SEQ ID NO: 692, or a CDR1 having one to two amino acid substitutions as compared to the sequence of SEQ ID NO: 692, (ii) a CDR2 having an amino acid sequence according to SEQ ID NO: 801, or a CDR2 having one to two amino acid substitutions as compared to the sequence of SEQ ID NO: 801, and (iii) a CDR3 having an amino acid sequence according to SEQ ID NO: 910, or a CDR3 having one to two amino acid substitutions as compared to the sequence of SEQ ID NO: 910. In some embodiments, the TL1A binding protein comprises a) a heavy chain variable region (VH) comprising (i) a CDR1 having an amino acid sequence according to SEQ ID NO: 365, (ii) a CDR2 having an amino acid sequence according to SEQ ID NO: 474, and (iii) a CDR3 having an amino acid sequence according to SEQ ID NO: 583; and b) a light chain variable region (VL) comprising (i) a CDR1 having an amino acid sequence according to SEQ ID NO: 692, (ii) a CDR2 having an amino acid sequence according to SEQ ID NO: 801, and (iii) a CDR3 having an amino acid sequence according to SEQ ID NO: 910. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 371, or a CDR1 having one to two amino acid substitutions as compared to the sequence of SEQ ID NO: 371, (ii) a CDR2 having an amino acid sequence according to SEQ ID NO: 480, or a CDR2 having one to two amino acid substitutions as compared to the sequence of SEQ ID NO: 480, and (iii) a CDR3 having an amino acid sequence according to SEQ ID NO: 589, or a CDR3 having one to two amino acid substitutions as compared to the sequence of SEQ ID NO: 589; and b) a light chain variable region (VL) comprising (i) a CDR1 having an amino acid sequence according to SEQ ID NO: 698, or a CDR1 having one to two amino acid substitutions as compared to the sequence of SEQ ID NO: 698, (ii) a CDR2 having an amino acid sequence according to SEQ ID NO: 807, or a CDR2 having one to two amino acid substitutions as compared to the sequence of SEQ ID NO: 807, and (iii) a CDR3 having an amino acid sequence according to SEQ ID NO: 916, or a CDR3 having one to two amino acid substitutions as compared to the sequence of SEQ ID NO: 916. In some embodiments, the TL1A binding protein comprises a) a heavy chain variable region (VH) comprising (i) a CDR1 having an amino acid sequence according to SEQ ID NO: 371, (ii) a CDR2 having an amino acid sequence according to SEQ ID NO: 480, and (iii) a CDR3 having an amino acid sequence according to SEQ ID NO: 589; and b) a light chain variable region (VL) comprising (i) a CDR1 having an amino acid sequence according to SEQ ID NO: 698, (ii) a CDR2 having an amino acid sequence according to SEQ ID NO: 807, and (iii) a CDR3 having an amino acid sequence according to SEQ ID NO: 916. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 372, or a CDR1 having one to two amino acid substitutions as compared to the sequence of SEQ ID NO: 372, (ii) a CDR2 having an amino acid sequence according to SEQ ID NO: 481, or a CDR2 having one to two amino acid substitutions as compared to the sequence of SEQ ID NO: 481, and (iii) a CDR3 having an amino acid sequence according to SEQ ID NO: 590, or a CDR3 having one to two amino acid substitutions as compared to the sequence of SEQ ID NO: 590; and b) a light chain variable region (VL) comprising (i) a CDR1 having an amino acid sequence according to SEQ ID NO: 699, or a CDR1 having one to two amino acid substitutions as compared to the sequence of SEQ ID NO: 699, (ii) a CDR2 having an amino acid sequence according to SEQ ID NO: 808, or a CDR2 having one to two amino acid substitutions as compared to the sequence of SEQ ID NO: 808, and (iii) a CDR3 having an amino acid sequence according to SEQ ID NO: 917, or a CDR3 having one to two amino acid substitutions as compared to the sequence of SEQ ID NO: 917. In some embodiments, the TL1A binding protein comprises a) a heavy chain variable region (VH) comprising (i) a CDR1 having an amino acid sequence according to SEQ ID NO: 372, (ii) a CDR2 having an amino acid sequence according to SEQ ID NO: 481, and (iii) a CDR3 having an amino acid sequence according to SEQ ID NO: 590; and b) a light chain variable region (VL) comprising (i) a CDR1 having an amino acid sequence according to SEQ ID NO: 699, (ii) a CDR2 having an amino acid sequence according to SEQ ID NO: 808, and (iii) a CDR3 having an amino acid sequence according to SEQ ID NO: 917. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 373, or a CDR1 having one to two amino acid substitutions as compared to the sequence of SEQ ID NO: 373, (ii) a CDR2 having an amino acid sequence according to SEQ ID NO: 482, or a CDR2 having one to two amino acid substitutions as compared to the sequence of SEQ ID NO: 482, and (iii) a CDR3 having an amino acid sequence according to SEQ ID NO: 591, or a CDR3 having one to two amino acid substitutions as compared to the sequence of SEQ ID NO: 591; and a light chain variable region (VL) comprising (i) a CDR1 having an amino acid sequence according to SEQ ID NO: 700, or a CDR1 having one to two amino acid substitutions as compared to the sequence of SEQ ID NO: 700, (ii) a CDR2 having an amino acid sequence according to SEQ ID NO: 809, or a CDR2 having one to two amino acid substitutions as compared to the sequence of SEQ ID NO: 809, and (iii) a CDR3 having an amino acid sequence according to SEQ ID NO: 918, or a CDR3 having one to two amino acid substitutions as compared to the sequence of SEQ ID NO: 918. In some embodiments, the TL1A binding protein comprises a) a heavy chain variable region (VH) comprising (i) a CDR1 having an amino acid sequence according to SEQ ID NO: 373, (ii) a CDR2 having an amino acid sequence according to SEQ ID NO: 482, and (iii) a CDR3 having an amino acid sequence according to SEQ ID NO: 591; and b) a light chain variable region (VL) comprising (i) a CDR1 having an amino acid sequence according to SEQ ID NO: 700, (ii) a CDR2 having an amino acid sequence according to SEQ ID NO: 809, and (iii) a CDR3 having an amino acid sequence according to SEQ ID NO: 918. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 388, or a CDR1 having one to two amino acid substitutions as compared to the sequence of SEQ ID NO: 388, (ii) a CDR2 having an amino acid sequence according to SEQ ID NO: 497, or a CDR2 having one to two amino acid substitutions as compared to the sequence of SEQ ID NO: 497, and (iii) a CDR3 having an amino acid sequence according to SEQ ID NO: 606, or a CDR3 having one to two amino acid substitutions as compared to the sequence of SEQ ID NO: 606; and a light chain variable region (VL) comprising (i) a CDR1 having an amino acid sequence according to SEQ ID NO: 715, or a CDR1 having one to two amino acid substitutions as compared to the sequence of SEQ ID NO: 715, (ii) a CDR2 having an amino acid sequence according to SEQ ID NO: 824, or a CDR2 having one to two amino acid substitutions as compared to the sequence of SEQ ID NO: 824, and (iii) a CDR3 having an amino acid sequence according to SEQ ID NO: 933, or a CDR3 having one to two amino acid substitutions as compared to the sequence of SEQ ID NO: 933. In some embodiments, the TL1A binding protein comprises a) a heavy chain variable region (VH) comprising (i) a CDR1 having an amino acid sequence according to SEQ ID NO: 388, (ii) a CDR2 having an amino acid sequence according to SEQ ID NO: 497, and (iii) a CDR3 having an amino acid sequence according to SEQ ID NO: 606; and b) a light chain variable region (VL) comprising (i) a CDR1 having an amino acid sequence according to SEQ ID NO: 715, (ii) a CDR2 having an amino acid sequence according to SEQ ID NO: 824, and (iii) a CDR3 having an amino acid sequence according to SEQ ID NO: 933. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 394, or a CDR1 having one to two amino acid substitutions as compared to the sequence of SEQ ID NO: 394, (ii) a CDR2 having an amino acid sequence according to SEQ ID NO: 503, or a CDR2 having one to two amino acid substitutions as compared to the sequence of SEQ ID NO: 503, and (iii) a CDR3 having an amino acid sequence according to SEQ ID NO: 612, or a CDR3 having one to two amino acid substitutions as compared to the sequence of SEQ ID NO: 612; and b) a light chain variable region (VL) comprising (i) a CDR1 having an amino acid sequence according to SEQ ID NO: 721, or a CDR1 having one to two amino acid substitutions as compared to the sequence of SEQ ID NO: 721, (ii) a CDR2 having an amino acid sequence according to SEQ ID NO: 830, or a CDR2 having one to two amino acid substitutions as compared to the sequence of SEQ ID NO: 830, and (iii) a CDR3 having an amino acid sequence according to SEQ ID NO: 939, or a CDR3 having one to two amino acid substitutions as compared to the sequence of SEQ ID NO: 939. In some embodiments, the TL1A binding protein comprises a) a heavy chain variable region (VH) comprising (i) a CDR1 having an amino acid sequence according to SEQ ID NO: 394, (ii) a CDR2 having an amino acid sequence according to SEQ ID NO: 503, and (iii) a CDR3 having an amino acid sequence according to SEQ ID NO: 612; and b) a light chain variable region (VL) comprising (i) a CDR1 having an amino acid sequence according to SEQ ID NO: 721, (ii) a CDR2 having an amino acid sequence according to SEQ ID NO: 830, and (iii) a CDR3 having an amino acid sequence according to SEQ ID NO: 939. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 400, or a CDR1 having one to two amino acid substitutions as compared to the sequence of SEQ ID NO: 400, (ii) a CDR2 having an amino acid sequence according to SEQ ID NO: 509, or a CDR2 having one to two amino acid substitutions as compared to the sequence of SEQ ID NO: 509, and (iii) a CDR3 having an amino acid sequence according to SEQ ID NO: 618, or a CDR3 having one to two amino acid substitutions as compared to the sequence of SEQ ID NO: 618; and b) a light chain variable region (VL) comprising (i) a CDR1 having an amino acid sequence according to SEQ ID NO: 727, or a CDR1 having one to two amino acid substitutions as compared to the sequence of SEQ ID NO: 727, (ii) a CDR2 having an amino acid sequence according to SEQ ID NO: 836, or a CDR2 having one to two amino acid substitutions as compared to the sequence of SEQ ID NO: 836, and (iii) a CDR3 having an amino acid sequence according to SEQ ID NO: 945, or a CDR3 having one to two amino acid substitutions as compared to the sequence of SEQ ID NO: 945. In some embodiments, the TL1A binding protein comprises a) a heavy chain variable region (VH) comprising (i) a CDR1 having an amino acid sequence according to SEQ ID NO: 400, (ii) a CDR2 having an amino acid sequence according to SEQ ID NO: 509, and (iii) a CDR3 having an amino acid sequence according to SEQ ID NO: 618; and b) a light chain variable region (VL) comprising (i) a CDR1 having an amino acid sequence according to SEQ ID NO: 727, (ii) a CDR2 having an amino acid sequence according to SEQ ID NO: 836, and (iii) a CDR3 having an amino acid sequence according to SEQ ID NO: 945. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein comprising a heavy chain variable region (VH) comprising: (i) a CDR1 having an amino acid sequence according to any one of SEQ ID NOs: 1-4 and 313-421, or having an amino acid sequence with one or two amino acid substitution as compared to any one of SEQ ID NOs: 1-4 and 313-421: (ii) a CDR2 having an amino acid sequence according to any one of SEQ ID NOs: 11-14 and 422-530, or having an amino acid sequence with one or two amino acid substitution as compared to any one of to any one of SEQ ID NOs: 11-14 and 422-530; and (iii) a CDR3 having an amino acid sequence according to any one of SEQ ID NOs: 21-24 and 531-639, or having an amino acid sequence with one or two amino acid substitution as compared to any one of to any one of SEQ ID NOs: 21-24 and 531-639.

Described herein is a TL1A binding protein comprising a light chain variable region (VL) comprising: (i) a CDR1 having an amino acid sequence according to any one of SEQ ID NOs: 31-34 and 640-748, or having an amino acid sequence with one or two amino acid substitution as compared to any one of SEQ ID NOs: 31-34 and 640-748; (ii) a CDR2 having an amino acid sequence according to any one of SEQ ID NOs: 41-44 and 749-857, or having an amino acid sequence with one or two amino acid substitution as compared to any one of SEQ ID NOs: 41-44 and 749-857; and (iii) a CDR3 having an amino acid sequence according to any one of SEQ ID NOs: 51-54 and 858-966, or having an amino acid sequence with one or two amino acid substitution as compared to any one of SEQ ID NOs: 51-54 and 858-966.

Aspects of the disclosure relate to a composition comprising the TL1A binding protein described herein and a pharmaceutically acceptable carrier, Aspects of the disclosure relate to an injectable liquid composition comprising the TL1A binding protein described herein and a pharmaceutically acceptable carrier.

Aspects of the disclosure relate to an isolated nucleic acid encoding the TL1A binding protein described herein.

Aspects of the disclosure relate to a recombinant host cell comprising the isolated nucleic acid.

Described herein is a method for producing a TL1A binding protein that specifically binds to a TL1A polypeptide comprising SEQ ID NO: 2493 or 2494, wherein the TL1A antigen binding protein is an antibody.

Aspects of the disclosure relate to a method to obtain an antibody that specifically binds to a certain epitope portion of a TL1A sequence comprising SEQ ID NO: 2493, wherein the method comprises assessing whether an antibody binds specifically to the certain epitope portion, wherein the certain epitope portion has ten or more amino acid residues selected from Val 101, Val 102, Arg 103, Gln 104, Thr 105, Pro 106, Thr 107, Gln 108, His 109, Phe 110, Lys 111, His 118, Trp 119, Glu 120, Glu 122, Leu 123, Gly 124, Lys 137, Arg 156, Gly 157, Met 158, Ser 234, Tyr 238, and Thr 239 of SEQ ID NO: 2493, and isolating or selecting the an antibody that binds to the certain epitope portion.

Aspects of the disclosure relate to a method to obtain an antibody that specifically binds to a certain epitope portion of a TL1A sequence comprising SEQ ID NO: 2493, wherein the method comprises assessing whether an antibody binds specifically to the certain epitope portion, wherein the certain epitope portion has amino acid residues Val 102, Arg 103, Gln 104, Thr 105, Thr 107, Gln 108, His 118, Trp 119, Glu 120, Glu 122, Leu 123, Gly 124, Lys 137, Arg 156, Gly 157, Met 158, Ser 234, Tyr 238, and Thr 239 of SEQ ID NO: 2493, and isolating or selecting the an antibody that binds to the certain epitope portion.

Aspects of the disclosure relate to a method for producing a TL1A binding protein that specifically binds to a TL1A polypeptide comprising SEQ ID NO: 2493 at any one of amino acid residues Table 12. 13, or 14, wherein the TL1A antigen binding protein is an antibody. In some embodiments, the TL1A binding antibody specifically binds to the TL1A polypeptide comprising SEQ ID NO: 2493 at any one of amino acid residues Lys240, Thr239, Tyr238, Asp237, Val236, Leu235, Ser234, Gln104, and Arg103. In some embodiments, the TL1A binding antibody specifically binds to the TL1A polypeptide comprising SEQ ID NO: 2493 at any one of amino acid residues Val 102, Arg 103, Gln 104, Glu 120, Glu 122, Leu 123, and Arg 156.

Aspects of the disclosure relate to method to obtain an antibody that specifically binds to a certain epitope portion of a TL1A sequence comprising SEQ ID NO: 2493 or SEQ ID NO: 2494, wherein the method comprises: assessing whether an antibody binds specifically to the certain epitope portion, and isolating or selecting the antibody that binds to the certain epitope portion wherein the certain epitope portion is recognized by an antibody described herein: or has amino acid residues Val 102, Arg 103, Gln 104, Glu 120, Glu 122, Leu 123, and Arg 156 of SEQ ID NO: 2493, or has amino acid residues Lys240, Thr239, Tyr238, Asp237, Val236, Leu235, Ser234, Gln104, and Arg103 of SEQ ID NO: 2493.

Aspects of the disclosure relate to a method to obtain an antibody that specifically binds to a certain epitope portion of a TL1A by competitively inhibiting binding of an antibody disclosed herein, such as antibody 1, 2, 3, 4, 6, 8, 10, 47, 49, 63, or 69 disclosed herein.

Aspects of the disclosure relate to a method of treating a gastrointestinal inflammatory disease in a patient in need thereof, the method comprising subcutaneously or intravenously administering to the patient an effective amount of a TL1A binding protein described herein. In some embodiments, administration of the TL1A binding protein is subcutaneous. In some embodiments, administration of the TL1A binding protein is intravenous. In some embodiments, the method comprises administering the TL1A binding protein to the patient 2 or more times at an interval of from about 2 weeks to about 12 weeks or more.

Aspects of the disclosure relate to a method of treating an inflammatory bowel disease in a patient in need thereof, the method comprising subcutaneously or intravenously administering to the patient an effective amount of a TL1A binding protein described herein. In some embodiments, the inflammatory bowel disease is Crohn's disease or ulcerative colitis. In some embodiments, administration of the TL1A binding protein is subcutaneous. In some embodiments, administration of the TL1A binding protein is intravenous. In some embodiments, the method comprises administering the TL1A binding protein to the patient 2 or more times at an interval of from about 2 weeks to about 12 weeks or more.

Aspects of the disclosure relate to a method of treating an inflammatory disease in a patient in need thereof, the method comprising subcutaneously or intravenously administering to the patient an effective amount of a TL1A binding protein described herein. In some embodiments, the inflammatory disease is psoriasis, psoriatic arthritis, or hidradenitis suppurativa.

In some embodiments, administration of the TL1A binding protein is subcutaneous. In some embodiments, administration of the TL1A binding protein is intravenous. In some embodiments, the method comprises administering the TL1A binding protein to the patient 2 or more times at an interval of from about 2 weeks to about 12 weeks or more.

BRIEF DESCRIPTION OF THE DRAWINGS

FIGS. 7A-7F depict chemical and pharmacokinetic data of TL1A binding antibodies described herein compared to various comparator antibodies.

DETAILED DESCRIPTION

Figure 1:
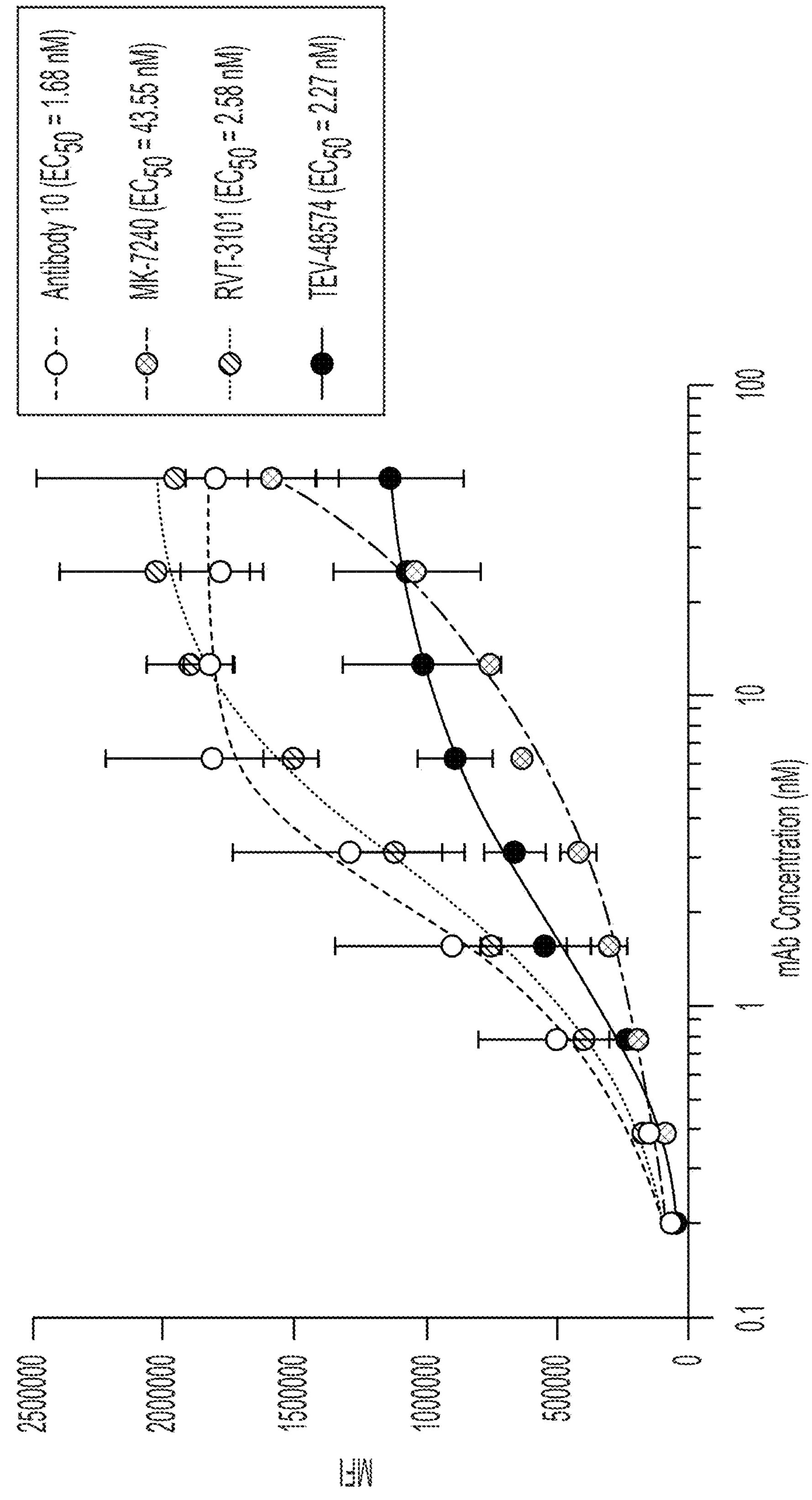
FIG. 1 is a graph depicting TL1A binding antibody described herein (Antibody 10) and various comparator antibodies binding membrane TL1A. Comparator antibody 1 has an amino acid sequence substantially identical to RVT-3101 and is referred herein as RVT-3101; Comparator antibody 2 has an amino acid sequence substantially identical to MK-7240) and is referred herein as MK-7240): Comparator antibody 3 has an amino acid sequence substantially identical to TEV-48574 and is referred herein as TEV-48574.

It is to be understood that both the foregoing general description and the following detailed description are exemplary, and explanatory only, and are not restrictive of the disclosure.

The section headings used herein are for organizational purposes only and are not to be construed as limiting the subject matter described.

All documents, or portions of documents, cited in this application, including, but not limited to, patents, patent applications, articles, books, and treatises, are hereby expressly incorporated by reference in their entirety for any purpose.

Definitions

Unless otherwise indicated, all technical terms used herein have the same meaning as commonly understood by one of ordinary skill in the art to which this invention belongs. Unless otherwise indicated or obvious from context, the following terms have the following meanings:

As used herein, unless otherwise indicated, the term "antibody" is understood to mean an intact antibody (e.g., an intact monoclonal antibody), or a fragment thereof, such as a Fc fragment of an antibody (e.g., an Fc fragment of a monoclonal antibody), or an antigen-binding fragment of an antibody (e.g., an antigen-binding fragment of a monoclonal antibody), including an intact antibody, antigen-binding fragment, or Fc fragment that has been modified, engineered, or chemically conjugated. In general, antibodies are multimeric proteins that contain four polypeptide chains. Two of the polypeptide chains are called immunoglobulin heavy chains (H chains), and two of the polypeptide chains are called immunoglobulin light chains (L chains). The immunoglobulin heavy and light chains are connected by an interchain disulfide bond. The immunoglobulin heavy chains are connected by interchain disulfide bonds. A light chain consists of one variable region (VL) and one constant region (CL). The heavy chain consists of one variable region (VH) and at least three constant regions (CH1, CH2 and CH3). The variable regions determine the binding specificity of the antibody. Each variable region contains three hypervariable regions known as complementarity determining regions (CDRs) flanked by four relatively conserved regions known as framework regions (FRs). The extent of the FRs and CDRs has been defined (Kabat et al. (1991) Sequences of Proteins of Immunological Interest, Fifth Edition, U.S. Department of Health and Human Services. NIH Publication No. 91-3242; and Chothia. C, et al. (1987) J. Mol. Biol. 196:901-917). The three CDRs, referred to as CDR1, CDR2, and CDR3, contribute to the antibody binding specificity. Naturally occurring antibodies have been used as starting material for engineered antibodies, such as chimeric antibodies and humanized antibodies. Examples of antibody-based antigen-binding fragments include Fab, Fab', (Fab')2, Fv, single chain antibodies (e.g., scFv), minibodies, and diabodies. Examples of antibodies that have been modified or engineered include chimeric antibodies, humanized antibodies, and multispecific antibodies (e.g., bispecific antibodies). An example of a chemically conjugated antibody is an antibody conjugated to a toxin moiety.

The terms "variable domain" and "variable region" are used interchangeably and refer to the portions of the antibody or immunoglobulin domains that exhibit variability in their sequence and that are involved in determining the specificity and binding affinity of a particular antibody. Variability is not evenly distributed throughout the variable domains of antibodies: it is concentrated in sub-domains of each of the heavy and light chain variable regions. These sub-domains are called "hypervariable regions" or "complementarity determining regions" (CDRs). The more conserved (i.e., non-hypervariable) portions of the variable domains are called the "framework" regions (FRM or FR) and provide a scaffold for the six CDRs in three-dimensional space to form an antigen-binding surface.

An "Fc polypeptide" of a dimeric Fc as used herein refers to one of the two polypeptides forming the dimeric Fc domain, i.e. a polypeptide comprising C-terminal constant regions of an immunoglobulin heavy chain, capable of stable self-association. For example, an Fc polypeptide of a dimeric IgG Fc comprises an IgG CH2 and an IgG CH3 constant domain sequence. An Fc can be of the class IgA, IgD, IgE, IgG, and IgM. These classes are also designated α, δ, ε, γ, and μ, respectively. Several of these may be further divided into subclasses (isotypes), e.g., IgG1, IgG2, IgG3, IgG4, IgA1, and IgA2.

The terms "Fc receptor" and "FcR" are used to describe a receptor that binds to the Fc region of an antibody. For example, an FcR can be a native sequence human FcR. Generally, an FcR is one which binds an IgG antibody (a gamma receptor) and includes receptors of the FcγRI. FcγRII, and FcγRIII subclasses, including allelic variants and alternatively spliced forms of these receptors. FcγRII receptors include FcγRIIA (an "activating receptor") and FcγRIIB (an "inhibiting receptor"), which have similar amino acid sequences that differ primarily in the cytoplasmic domains thereof. Immunoglobulins of other isotypes can also be bound by certain FcRs (see, e.g., Janeway et al., Immuno Biology: the immune system in health and disease, (Elsevier Science Ltd., NY) (4th ed., 1999)). Activating receptor FcγRIIA contains an immunoreceptor tyrosine-based activation motif (ITAM) in its cytoplasmic domain. Inhibiting receptor FcγRIIB contains an immunoreceptor tyrosine-based inhibition motif (ITIM) in its cytoplasmic domain (reviewed in Daëron, Annu. Rev. Immunol. 15:203-234 (1997)). FcRs are reviewed in Ravetch and Kinet. Annu. Rev. Immunol 9:457-92 (1991): Capel et al., Immunomethods 4:25-34 (1994); and de Haas et al., J. Lab. Clin. Med. 126:330-41 (1995). Other FcRs, including those to be identified in the future, are encompassed by the term "FcR" herein. The term also includes the neonatal receptor, FcRn, which is responsible for the transfer of maternal IgGs to the fetus (Guyer et al., J. Immunol. 117:587 (1976); and Kim et al., J. Immunol. 24:249 (1994)).

The terms "recipient", "individual", "subject", "host", and "patient", are used interchangeably herein and in some embodiments, refer to any mammalian subject for whom diagnosis, treatment, or therapy is desired, particularly humans. "Mammal" for purposes of treatment refers to any animal classified as a mammal, including humans, domestic and farm animals, and laboratory, zoo, sports, or pet animals, such as dogs, horses, cats, cows, sheep, goats, pigs, mice, rats, rabbits, guinea pigs, monkeys etc. In some embodiments, the mammal is human. None of these terms require the supervision of medical personnel.

As used herein, the term "effective amount" refers to the amount of a compound (e.g., a compound of the present disclosure) sufficient to effect beneficial or desired results. An effective amount can be administered in one or more administrations, applications or dosages and is not intended to be limited to a particular formulation or administration route. As used herein, the term "treating" includes any effect, e.g., lessening, reducing, modulating, ameliorating or eliminating, that results in the improvement of the condition, disease, disorder, and the like, or ameliorating a symptom thereof.

As used herein, the term "pharmaceutical composition" refers to the combination of an active agent with a carrier, inert or active, making the composition especially suitable for diagnostic or therapeutic use in vivo or ex vivo.

As used herein, the term "pharmaceutically acceptable carrier" refers to any of the standard pharmaceutical carriers, such as a phosphate buffered saline solution, water, emulsions (e.g., such as an oil/water or water/oil emulsions), and various types of wetting agents. The compositions also can include stabilizers and preservatives. For examples of carriers, stabilizers and adjuvants, see e.g., Martin, Remington's Pharmaceutical Sciences, 15th Ed., Mack Publ. Co., Easton, PA (1975).

The terms "a" and "an" as used herein mean "one or more" and include the plural unless the context is inappropriate.

As used herein, all numerical values or numerical ranges include whole integers within or encompassing such ranges and fractions of the values or the integers within or encompassing ranges unless the context clearly indicates otherwise. Thus, for example, reference to a range of 90-100%, includes 91%, 92%, 93%, 94%, 95%, 95%, 96%, 97%, etc., as well as 91.1%, 91.2%, 91.3%, 91.4%, 91.5%, etc., 92.1%, 92.2%, 92.3%, 92.4%, 92.5%, etc., and so forth. In another example, reference to a range of 1-5,000-fold includes 1, 2, 3, 4, 5, 6, 7, 8, 9, 10, 11, 12, 13, 14, 15, 16, 17, 18, 19, 20, fold, etc., as well as 1.1, 1.2, 1.3, 1.4, 1.5, fold, etc., 2.1, 2.2, 2.3, 2.4, 2.5, fold, etc., and so forth.

"About" a number, as used herein, refers to range including the number and ranging from 10% below that number to 10% above that number. "About" a range refers to 10% below the lower limit of the range, spanning to 10% above the upper limit of the range.

"Percent (%) identity" refers to the extent to which two sequences (nucleotide or amino acid) have the same residue at the same positions in an alignment. For example, "an amino acid sequence is X % identical to SEQ ID NO: Y" refers to % identity of the amino acid sequence to SEQ ID NO: Y and is elaborated as X % of residues in the amino acid sequence are identical to the residues of sequence disclosed in SEQ ID NO: Y. Generally, computer programs are employed for such calculations. Exemplary programs that compare and align pairs of sequences include ALIGN (Myers and Miller, 1988), FASTA (Pearson and Lipman, 1988; Pearson, 1990) and gapped BLAST (Altschul et al., 1997), BLASTP, BLASTN, or GCG (Devereux et al., 1984).

Throughout the description, where compositions are described as having, including, or comprising specific components, or where processes and methods are described as having, including, or comprising specific steps, it is contemplated that, additionally, there are compositions of the present disclosure that consist essentially of, or consist of, the recited components, and that there are processes and methods according to the present disclosure that consist essentially of, or consist of, the recited processing steps.

As a general matter, compositions specifying a percentage are by weight unless otherwise specified. Further, if a variable is not accompanied by a definition, then the previous definition of the variable controls.

TL1A Binding Proteins

Provided herein are compositions, systems, and methods comprising a TL1A binding protein. The TL1A binding proteins described herein can bind to TL1A monomers, TL1A trimers, or both, may have picomolar potency against TL1A monomers, TL1A trimers, or both, and may have extended half-life (e.g., as compared to known TL1A directed antibodies), or combinations thereof. In some embodiments, the TL1A binding proteins described herein allow for subcutaneous administration. In some embodiments, the TL1A binding proteins described herein allow for dosing e.g., every 8 weeks or every 12 weeks, or more. TL1A binding proteins binding proteins described herein may also have improved specificity. TL1A binding proteins binding proteins described herein may have specificity for monomeric and trimeric TL1A and not to related TNF super family proteins TNF, FasL, TRAIL, or LIGHT.

Described herein is a TL1A binding protein, wherein the TL1A binding protein comprises a) a heavy chain variable region (VH) comprising (i) a CDR1 having an amino acid sequence according to SEQ ID NO: 5, or a CDR1 having one to two amino acid substitutions as compared to the sequence of SEQ ID NO: 5, (ii) a CDR2 having an amino acid sequence according to SEQ ID NO: 15, or a CDR2 having one to two amino acid substitutions as compared to the sequence of SEQ ID NO: 15, and (iii) a CDR3 having an amino acid sequence according to SEQ ID NO: 25, or a CDR3 having one to two amino acid substitutions as compared to the sequence of SEQ ID NO: 25; and b) a light chain variable region (VL) comprising (i) a CDR1 having an amino acid sequence according to SEQ ID NO: 35, or a CDR1 having one to two amino acid substitutions as compared to the sequence of SEQ ID NO: 35, (ii) a CDR2 having an amino acid sequence according to SEQ ID NO: 45, or a CDR2 having one to two amino acid substitutions as compared to the sequence of SEQ ID NO: 45, and (iii) a CDR3 having an amino acid sequence according to SEQ ID NO: 55, or a CDR3 having one to two amino acid substitutions as compared to the sequence of SEQ ID NO: 55. In some embodiments, the TL1A binding protein comprises a) a heavy chain variable region (VH) comprising (i) a CDR1 having an amino acid sequence according to SEQ ID NO: 5, (ii) a CDR2 having an amino acid sequence according to SEQ ID NO: 15, and (iii) a CDR3 having an amino acid sequence according to SEQ ID NO: 25; and b) a light chain variable region (VL) comprising (i) a CDR1 having an amino acid sequence according to SEQ ID NO: 35, (ii) a CDR2 having an amino acid sequence according to SEQ ID NO: 45, and (iii) a CDR3 having an amino acid sequence according to SEQ ID NO: 55. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 6, or a CDR1 having one to two amino acid substitutions as compared to the sequence of SEQ ID NO: 6, (ii) a CDR2 having an amino acid sequence according to SEQ ID NO: 16, or a CDR2 having one to two amino acid substitutions as compared to the sequence of SEQ ID NO: 16, and (iii) a CDR3 having an amino acid sequence according to SEQ ID NO: 26, or a CDR3 having one to two amino acid substitutions as compared to the sequence of SEQ ID NO: 26; and b) a light chain variable region (VL) comprising (i) a CDR1 having an amino acid sequence according to SEQ ID NO: 36, or a CDR1 having one to two amino acid substitutions as compared to the sequence of SEQ ID NO: 36, (ii) a CDR2 having an amino acid sequence according to SEQ ID NO: 46, or a CDR2 having one to two amino acid substitutions as compared to the sequence of SEQ ID NO: 46, and (iii) a CDR3 having an amino acid sequence according to SEQ ID NO: 56, or a CDR3 having one to two amino acid substitutions as compared to the sequence of SEQ ID NO: 56. In some embodiments, the TL1A binding protein comprises a) a heavy chain variable region (VH) comprising (i) a CDR1 having an amino acid sequence according to SEQ ID NO: 6, (ii) a CDR2 having an amino acid sequence according to SEQ ID NO: 16, and (iii) a CDR3 having an amino acid sequence according to SEQ ID NO: 26; and b) a light chain variable region (VL) comprising (i) a CDR1 having an amino acid sequence according to SEQ ID NO: 36, (ii) a CDR2 having an amino acid sequence according to SEQ ID NO: 46, and (iii) a CDR3 having an amino acid sequence according to SEQ ID NO: 56. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 7, or a CDR1 having one to two amino acid substitutions as compared to the sequence of SEQ ID NO: 7, (ii) a CDR2 having an amino acid sequence according to SEQ ID NO: 17, or a CDR2 having one to two amino acid substitutions as compared to the sequence of SEQ ID NO: 17, and (iii) a CDR3 having an amino acid sequence according to SEQ ID NO: 27, or a CDR3 having one to two amino acid substitutions as compared to the sequence of SEQ ID NO: 27; and b) a light chain variable region (VL) comprising (i) a CDR1 having an amino acid sequence according to SEQ ID NO: 37, or a CDR1 having one to two amino acid substitutions as compared to the sequence of SEQ ID NO: 37, (ii) a CDR2 having an amino acid sequence according to SEQ ID NO: 47, or a CDR2 having one to two amino acid substitutions as compared to the sequence of SEQ ID NO: 47, and (iii) a CDR3 having an amino acid sequence according to SEQ ID NO: 57, or a CDR3 having one to two amino acid substitutions as compared to the sequence of SEQ ID NO: 57. In some embodiments, the TL1A binding protein comprises a) a heavy chain variable region (VH) comprising (i) a CDR1 having an amino acid sequence according to SEQ ID NO: 7, (ii) a CDR2 having an amino acid sequence according to SEQ ID NO: 17, and (iii) a CDR3 having an amino acid sequence according to SEQ ID NO: 27; and b) a light chain variable region (VL) comprising (i) a CDR1 having an amino acid sequence according to SEQ ID NO: 37, (ii) a CDR2 having an amino acid sequence according to SEQ ID NO: 47, and (iii) a CDR3 having an amino acid sequence according to SEQ ID NO: 57. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 8, or a CDR1 having one to two amino acid substitutions as compared to the sequence of SEQ ID NO: 8, (ii) a CDR2 having an amino acid sequence according to SEQ ID NO: 18, or a CDR2 having one to two amino acid substitutions as compared to the sequence of SEQ ID NO: 18, and (iii) a CDR3 having an amino acid sequence according to SEQ ID NO: 28, or a CDR3 having one to two amino acid substitutions as compared to the sequence of SEQ ID NO: 28; and b) a light chain variable region (VL) comprising (i) a CDR1 having an amino acid sequence according to SEQ ID NO: 38, or a CDR1 having one to two amino acid substitutions as compared to the sequence of SEQ ID NO: 38, (ii) a CDR2 having an amino acid sequence according to SEQ ID NO: 48, or a CDR2 having one to two amino acid substitutions as compared to the sequence of SEQ ID NO: 48, and (iii) a CDR3 having an amino acid sequence according to SEQ ID NO: 58, or a CDR3 having one to two amino acid substitutions as compared to the sequence of SEQ ID NO: 58. In some embodiments, the TL1A binding protein comprises a) a heavy chain variable region (VH) comprising (i) a CDR1 having an amino acid sequence according to SEQ ID NO: 8, (ii) a CDR2 having an amino acid sequence according to SEQ ID NO: 18, and (iii) a CDR3 having an amino acid sequence according to SEQ ID NO: 28; and b) a light chain variable region (VL) comprising (i) a CDR1 having an amino acid sequence according to SEQ ID NO: 38, (ii) a CDR2 having an amino acid sequence according to SEQ ID NO: 48, and (iii) a CDR3 having an amino acid sequence according to SEQ ID NO: 58. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 9, or a CDR1 having one to two amino acid substitutions as compared to the sequence of SEQ ID NO: 9, (ii) a CDR2 having an amino acid sequence according to SEQ ID NO: 19, or a CDR2 having one to two amino acid substitutions as compared to the sequence of SEQ ID NO: 19, and (iii) a CDR3 having an amino acid sequence according to SEQ ID NO: 29, or a CDR3 having one to two amino acid substitutions as compared to the sequence of SEQ ID NO: 29; and b) a light chain variable region (VL) comprising (i) a CDR1 having an amino acid sequence according to SEQ ID NO: 39, or a CDR1 having one to two amino acid substitutions as compared to the sequence of SEQ ID NO: 39, (ii) a CDR2 having an amino acid sequence according to SEQ ID NO: 49, or a CDR2 having one to two amino acid substitutions as compared to the sequence of SEQ ID NO: 49, and (iii) a CDR3 having an amino acid sequence according to SEQ ID NO: 59, or a CDR3 having one to two amino acid substitutions as compared to the sequence of SEQ ID NO: 59. In some embodiments, the TL1A binding protein comprises a) a heavy chain variable region (VH) comprising (i) a CDR1 having an amino acid sequence according to SEQ ID NO: 9, (ii) a CDR2 having an amino acid sequence according to SEQ ID NO: 19, and (iii) a CDR3 having an amino acid sequence according to SEQ ID NO: 29; and a light chain variable region (VL) comprising (i) a CDR1 having an amino acid sequence according to SEQ ID NO: 39, (ii) a CDR2 having an amino acid sequence according to SEQ ID NO: 49, and (iii) a CDR3 having an amino acid sequence according to SEQ ID NO: 59. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 10, or a CDR1 having one to two amino acid substitutions as compared to the sequence of SEQ ID NO: 10, (ii) a CDR2 having an amino acid sequence according to SEQ ID NO: 20, or a CDR2 having one to two amino acid substitutions as compared to the sequence of SEQ ID NO: 20, and (iii) a CDR3 having an amino acid sequence according to SEQ ID NO: 30, or a CDR3 having one to two amino acid substitutions as compared to the sequence of SEQ ID NO: 30; and b) a light chain variable region (VL) comprising (i) a CDR1 having an amino acid sequence according to SEQ ID NO: 40, or a CDR1 having one to two amino acid substitutions as compared to the sequence of SEQ ID NO: 40, (ii) a CDR2 having an amino acid sequence according to SEQ ID NO: 50, or a CDR2 having one to two amino acid substitutions as compared to the sequence of SEQ ID NO: 50, and (iii) a CDR3 having an amino acid sequence according to SEQ ID NO: 60, or a CDR3 having one to two amino acid substitutions as compared to the sequence of SEQ ID NO: 60. In some embodiments, the TL1A binding protein comprises a) a heavy chain variable region (VH) comprising (i) a CDR1 having an amino acid sequence according to SEQ ID NO: 10, (ii) a CDR2 having an amino acid sequence according to SEQ ID NO: 20, and (iii) a CDR3 having an amino acid sequence according to SEQ ID NO: 30; and a light chain variable region (VL) comprising (i) a CDR1 having an amino acid sequence according to SEQ ID NO: 40, (ii) a CDR2 having an amino acid sequence according to SEQ ID NO: 50, and (iii) a CDR3 having an amino acid sequence according to SEQ ID NO: 60. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

In some embodiments the TL1A binding antibody specifically binds to an epitope on a TL1A polypeptide recognized by an antibody disclosed herein. In some embodiments the TL1A binding antibody specifically binds to an epitope on a TL1A polypeptide recognized by antibody 1, 2, 3, 4, 6, 8, 10, 47, 49, 63, or 69 disclosed herein.

In some embodiments the TL1A binding antibody binds specifically to a TL1A polypeptide comprising SEQ ID NO: 2493 at any one of amino acid residues Val 101, Val 102, Arg 103, Gln 104, Thr 105, Pro 106, Thr 107, Gln 108, His 109, Phe 110, Lys 111, His 118, Trp 119, Glu 120, Glu 122, Leu 123, Gly 124, Lys 137, Arg 156, Gly 157, Met 158, Ser 231, Asp 232, Ile 233, Ser 234, Tyr 238, Thr 239, Lys 240, and Lys 243. In some embodiments, the TL1A binding antibody specifically binds to the TL1A sequences at ten or more amino acid residues selected from Val 102, Arg 103, Gln 104, Thr 105, Thr 107, Gln 108, His 118, Trp 119, Glu 120. Glu 122, Leu 123, Gly 124, Lys 137, Arg 156, Gly 157, Met 158, Ser 231, Asp 232, Ile 233, Ser 234, Leu 235, Val 236, Asp 237, Tyr 238, Thr 239, Lys 240, and Lys 243 of SEQ ID NO: 2493. In some embodiments, the TL1A binding antibody specifically binds to the TL1A sequences at ten or more amino acid residues selected from Arg103, Gln104, Ser234, Leu235, Val236, Asp237, Tyr238, Thr239, and Lys240 of SEQ ID NO: 2493. In some embodiments, the TL1A antigen binding protein is an antibody.

In some embodiments the TL1A binding protein specifically binds to an epitope of TL1A. In some embodiments, the TL1A binding protein specifically binds to a TL1A polypeptide comprising SEQ ID NO: 2493 at any one of amino acid residues Val 102, Arg 103, Gln 104, Thr 105, Thr 107, Gln 108, His 118, Trp 119, Glu 120, Glu 122, Leu 123, Gly 124, Lys 137, Arg 156, Gly 157, Met 158, Ser 234, Tyr 238, and Thr 239. In some embodiments, the TL1A binding protein specifically binds to the TL1A sequences at amino acid residues Arg103, Gln104, Ser234, Leu235, Val236, Asp237, Tyr238, Thr239, and Lys240.

Described herein, in some embodiments, are TL1A binding proteins, wherein the TL1A binding protein specifically binds to a TL1A polypeptide comprising SEQ ID NO: 2493 at any one of amino acid residues Val 102, Arg 103, Gln 104, Thr 105, Thr 107, Gln 108, His 118, Trp 119, Glu 120, Glu 122, Leu 123, Gly 15 124, Lys 137, Arg 156, Gly 157, Met 158, Ser 234, Tye 238, and Trh 239, wherein the TL1A binding protein is an antibody. In some embodiments, the TL1A binding protein specifically binds to the TL1A sequences at amino acid residues Val 102, Arg 103, Gln 104, Thr 105, Thr 107, Gln 108, His 118, Trp 119, Glu 120, Glu 122, Leu 123, Gly 124, Lys 137, Arg 156, Gly 157, Met 158, Ser 234, Tye 238, and Thr 239.

In some embodiments, the TL1A binding protein specifically binds to the TL1A sequences at least at 1, 2, 3, 4, 5, 6, 7, 8, 9, 10, 11, 12, 13, 14, 15, 16, 17, 18, or all 19 of amino acid residues Val 102, Arg 103, Gln 104, Thr 105, Thr 107, Gln 108, His 118, Trp 119, Glu 120, Glu 122, Leu 123, Gly 124, Lys 137, Arg 156, Gly 157, Met 158, Ser 234, Tye 238, and Thr 239 of SEQ ID NO: 2493.

In some embodiments, the TL1A binding protein specifically binds to the TL1A sequences at least at 10, 11, 12, 13, 14, 15, 16, 17, 18, 19, 20, 21, 22, 23, 24, 25, 26, 27, 28 or all of amino acid residues Val 101, Val 102, Arg 103, Gln 104, Thr 105, Pro 106, Thr 107, His 118, Trp 119, Glu 120, His 121, Glu 122, Leu 123, Gly 124, Tyr 134, Asn 136, Arg 156, Gly 157, Met 158, Thr 159, Ser 206, Asn 207, Ser 234, Leu 235, Val 236, Asp 237, Tyr 238, Thr 239, and Lys 240 of SEQ ID NO: 2493.

In some embodiments, the TL1A binding protein specifically binds to the TL1A sequences at least at 16, 17, 18, 19, 20, 21, 22, 23, 24, 25, 26, 27, 28, 29, 30, 31, 32, 33, 34, or all of amino acid residues Arg 103, Gln 104, Thr 105, Pro 106, Thr 107, Gln 108, His 109, Phe 110, Lys 111, Pro 115, Arg 156, Met 158, Thr 159, Ser 160, Glu 161, Ala 168, Gly 169, Arg 170, Pro 171, Lys 173, Asp 175, Gln 193, Ser 206, Asn 207, Ser 231, Asp 232, Ile 233, Ser 234, Leu 235, Val 236, Asp 237, Tyr 238, Thr 239, Lys 240, and Lys 243 of SEQ ID NO: 2493.

In some embodiments, the TL1A binding protein specifically binds to the TL1A sequences at least at 3, 4, 5, 6, 7, 8, 9, 10, 11, 12, 13, 14, 15, 16, 17, 18, 19, 21, 22, or all of amino acid residues Val 102, Arg 103, Gln 104, Thr 105, Pro 106, Thr 107, Gln 108, His 109, Asn 112, Pro 115, Leu 117, Arg 156, Gly 157, Met 158, Thr 159, Ser 160, Glu 161, Arg 170, Lys 173, Asp 175, Ser 176, Val 201, Ser 206, Asn 207, Trp 208, Phe 209, Asp 232, Ile 233, Ser 234, Leu 235, Val 236, Asp 237, Tyr 238, Thr 239, Lys 240, and Lys 243 of SEQ ID NO: 2493.

In some embodiments, the TL1A binding protein specifically binds to the TL1A sequences at least at 4, 5, 6, 7, 8, 9, 10, 11, 12, 13, 14, 15, 16, 17, 18, 19, 20, 21, 22, or all of amino acid residues Val 101, Val 102, Arg 103, Gln 104, His 118, Trp 119, Glu 120, His 121, Glu 122, Leu 123, Gly 124, Tyr 134, Thr 135, Lys 137, Tyr 188, Glu 190, Pro 191, Thr 192, Gln 193, Thr 239, Lys 240, Glu 241, and Asp 272 of SEQ ID NO: 2493.

In some embodiments, the TL1A binding protein specifically binds to the TL1A sequences at least at 1, 2, 3, 4, 5, 6, 7, 8, 9, 10, 11, 12, 13, 14, or all of amino acid residues Val 102, Arg 103, Gln 104, Pro 106, His 118, Glu 120, Glu 122, Leu 123, Gly 124, Asn 136, Arg 156, Gly 157, Ser 234, Tyr 238, and Thr 239 of SEQ ID NO: 2493.

In some embodiments, the TL1A binding protein specifically binds to the TL1A sequences at least at 1, 2, 3, 4, 5, 6, 7, 8, 9, 10, 11, 12, or all of amino acid residues Val 101, Val 102, Arg 103, Gln 104, Thr 105, Gln 108, Glu 120, Glu 122, Leu 123, Arg 156, Gly 157, Met 158, and Tyr 238 of SEQ ID NO: 2493.

In some embodiments, the TL1A binding protein specifically binds to the TL1A sequences at least at 1, 2, 3, 4, 5, 6, 7, 8, 9, 10, 11, 12, 13, 14, or all of amino acid residues Val 101, Val 102, Arg 103, Gln 104, Thr 105, Pro 106, His 118, Glu 120, Glu 122, Leu 123, Gly 124, Arg 156, Ser 234, Tyr 238, and Thr 239 of SEQ ID NO: 2493.

In some embodiments, the TL1A binding protein specifically binds to the TL1A sequences at least at 11, 12, 13, 14, 15, 16, 17, 18, 19, 20, 21, 22, 23, 24, 25, 26, 27, 28, 29, or all of amino acid residues Val 101, Val 102, Arg 103, Gln 104, Thr 105, Pro 106, Thr 107, Gln 108, His 109, Phe 110, Lys 111, Leu 117, His 118, Trp 119, Arg 156, Gly 157, Lys 173, Met 196, Ser 206, Ser 231, Asp 232, Ile 233, Ser 234, Leu 235, Val 236, Asp 237, Tyr 238, Thr 239, Lys 240, and Lys 243 of SEQ ID NO: 2493.

In some embodiments, the TL1A binding protein specifically binds to the TL1A sequences at least at 12, 13, 14, 15, 16, 17, 18, 19, 20, 21, 22, 23, 24, 25, 26, 27, 28, 29, 30 or all of amino acid residues Val 101, Val 102, Arg 103, Gln 104, Thr 105, Pro 106, Thr 107, Gln 108, His 109, Phe 110, Lys 111, Gln 113, Pro 115, Leu 117, His 118, Trp 119, Arg 156, Lys 173, Ser 206, Asn 207, Ser 231, Asp 232, Ile 233, Ser 234, Leu 235, Val 236, Asp 237, Tyr 238, Thr 239, Lys 240, and Lys 243 of SEQ ID NO: 2493.

In some embodiments, the TL1A binding protein specifically binds to the TL1A sequences at least at 8, 9, 10, 11, 12, 13, 14, 15, 16, 17, 18, 19, 20, 21, 22, 23, 24, 25, 26, or all of amino acid residues Val 101, Val 102, Arg 103, Gln 104, Thr 105, Pro 106, Thr 107, Gln 108, His 109, Phe 110, Lys 111, Leu 117, His 118, Trp 119, Arg 156, Lys 173, Ser 231, Asp 232, Ile 233, Ser 234, Leu 235, Val 236, Asp 237, Tyr 238, Thr 239, Lys 240, and Lys 243 of SEQ ID NO: 2493.

In some embodiments, the TL1A binding protein specifically binds to the TL1A sequences at least at 9, 10, 11, 12, 13, 14, 15, 16, 17, 18, 19, 20, 21, 22, 23, 24, 25, 26, 27, or all of amino acid residues Thr 100, Val 101, Val 102, Arg 103, Gln 104, Thr 105, Pro 106, Thr 107, Gln 108, His 109, Phe 110, Lys 111, Gln 113, Pro 115, His 118, Trp 119, Glu 120, Arg 156, Asp 232, Ile 233, Ser 234, Leu 235, Val 236, Asp 237, Tyr 238, Thr 239, Lys 240, and Lys 243 of SEQ ID NO: 2493.

In some embodiments the amino acid residue of the TL1A epitope bind the paratope of the antibody with a distance of 6 Angstroms or less, 5 Angstroms or less, 4 Angstroms or less, 3 Angstroms or less, or 2 Angstroms or less.

Described herein is a TL1A binding protein, wherein the TL1A binding protein comprises a) a heavy chain variable region (VH) comprising (i) a CDR1 having an amino acid sequence according to SEQ ID NO: 1, or a CDR1 having one to two amino acid substitutions as compared to the sequence of SEQ ID NO: 1, (ii) a CDR2 having an amino acid sequence according to SEQ ID NO: 11, or a CDR2 having one to two amino acid substitutions as compared to the sequence of SEQ ID NO: 11, and (iii) a CDR3 having an amino acid sequence according to SEQ ID NO: 21, or a CDR3 having one to two amino acid substitutions as compared to the sequence of SEQ ID NO: 21; and b) a light chain variable region (VL) comprising (i) a CDR1 having an amino acid sequence according to SEQ ID NO: 31, or a CDR1 having one to two amino acid substitutions as compared to the sequence of SEQ ID NO: 31, (ii) a CDR2 having an amino acid sequence according to SEQ ID NO: 41, or a CDR2 having one to two amino acid substitutions as compared to the sequence of SEQ ID NO: 41, and (iii) a CDR3 having an amino acid sequence according to SEQ ID NO: 51, or a CDR3 having one to two amino acid substitutions as compared to the sequence of SEQ ID NO: 51. In some embodiments, the TL1A binding protein comprises a) a heavy chain variable region (VH) comprising (i) a CDR1 having an amino acid sequence according to SEQ ID NO: 1, (ii) a CDR2 having an amino acid sequence according to SEQ ID NO: 11, and (iii) a CDR3 having an amino acid sequence according to SEQ ID NO: 21; and b) a light chain variable region (VL) comprising (i) a CDR1 having an amino acid sequence according to SEQ ID NO: 31, (ii) a CDR2 having an amino acid sequence according to SEQ ID NO: 41, and (iii) a CDR3 having an amino acid sequence according to SEQ ID NO: 51. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 2, or a CDR1 having one to two amino acid substitutions as compared to the sequence of SEQ ID NO: 2, (ii) a CDR2 having an amino acid sequence according to SEQ ID NO: 12, or a CDR2 having one to two amino acid substitutions as compared to the sequence of SEQ ID NO: 12, and (iii) a CDR3 having an amino acid sequence according to SEQ ID NO: 22, or a CDR3 having one to two amino acid substitutions as compared to the sequence of SEQ ID NO: 22; and a light chain variable region (VL) comprising (i) a CDR1 having an amino acid sequence according to SEQ ID NO: 32, or a CDR1 having one to two amino acid substitutions as compared to the sequence of SEQ ID NO: 32, (ii) a CDR2 having an amino acid sequence according to SEQ ID NO: 42, or a CDR2 having one to two amino acid substitutions as compared to the sequence of SEQ ID NO: 42, and (iii) a CDR3 having an amino acid sequence according to SEQ ID NO: 52, or a CDR3 having one to two amino acid substitutions as compared to the sequence of SEQ ID NO: 52. In some embodiments, the TL1A binding protein comprises a) a heavy chain variable region (VH) comprising (i) a CDR1 having an amino acid sequence according to SEQ ID NO: 2, (ii) a CDR2 having an amino acid sequence according to SEQ ID NO: 12, and (iii) a CDR3 having an amino acid sequence according to SEQ ID NO: 22; and b) a light chain variable region (VL) comprising (i) a CDR1 having an amino acid sequence according to SEQ ID NO: 32, (ii) a CDR2 having an amino acid sequence according to SEQ ID NO: 42, and (iii) a CDR3 having an amino acid sequence according to SEQ ID NO: 52. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 3, or a CDR1 having one to two amino acid substitutions as compared to the sequence of SEQ ID NO: 3, (ii) a CDR2 having an amino acid sequence according to SEQ ID NO: 13, or a CDR2 having one to two amino acid substitutions as compared to the sequence of SEQ ID NO: 13, and (iii) a CDR3 having an amino acid sequence according to SEQ ID NO: 23, or a CDR3 having one to two amino acid substitutions as compared to the sequence of SEQ ID NO: 23; and b) a light chain variable region (VL) comprising (i) a CDR1 having an amino acid sequence according to SEQ ID NO: 33, or a CDR1 having one to two amino acid substitutions as compared to the sequence of SEQ ID NO: 33, (ii) a CDR2 having an amino acid sequence according to SEQ ID NO: 43, or a CDR2 having one to two amino acid substitutions as compared to the sequence of SEQ ID NO: 43, and (iii) a CDR3 having an amino acid sequence according to SEQ ID NO: 53, or a CDR3 having one to two amino acid substitutions as compared to the sequence of SEQ ID NO: 53. In some embodiments, the TL1A binding protein comprises a) a heavy chain variable region (VH) comprising (i) a CDR1 having an amino acid sequence according to SEQ ID NO: 3, (ii) a CDR2 having an amino acid sequence according to SEQ ID NO: 13, and (iii) a CDR3 having an amino acid sequence according to SEQ ID NO: 23; and b) a light chain variable region (VL) comprising (i) a CDR1 having an amino acid sequence according to SEQ ID NO: 33, (ii) a CDR2 having an amino acid sequence according to SEQ ID NO: 43, and (iii) a CDR3 having an amino acid sequence according to SEQ ID NO: 53. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 4, or a CDR1 having one to two amino acid substitutions as compared to the sequence of SEQ ID NO: 4, (ii) a CDR2 having an amino acid sequence according to SEQ ID NO: 14, or a CDR2 having one to two amino acid substitutions as compared to the sequence of SEQ ID NO: 14, and (iii) a CDR3 having an amino acid sequence according to SEQ ID NO: 24, or a CDR3 having one to two amino acid substitutions as compared to the sequence of SEQ ID NO: 24; and a light chain variable region (VL) comprising (i) a CDR1 having an amino acid sequence according to SEQ ID NO: 34, or a CDR1 having one to two amino acid substitutions as compared to the sequence of SEQ ID NO: 34, (ii) a CDR2 having an amino acid sequence according to SEQ ID NO: 44, or a CDR2 having one to two amino acid substitutions as compared to the sequence of SEQ ID NO: 44, and (iii) a CDR3 having an amino acid sequence according to SEQ ID NO: 54, or a CDR3 having one to two amino acid substitutions as compared to the sequence of SEQ ID NO: 54. In some embodiments, the TL1A binding protein comprises a) a heavy chain variable region (VH) comprising (i) a CDR1 having an amino acid sequence according to SEQ ID NO: 4, (ii) a CDR2 having an amino acid sequence according to SEQ ID NO: 14, and (iii) a CDR3 having an amino acid sequence according to SEQ ID NO: 24; and b) a light chain variable region (VL) comprising (i) a CDR1 having an amino acid sequence according to SEQ ID NO: 34, (ii) a CDR2 having an amino acid sequence according to SEQ ID NO: 44, and (iii) a CDR3 having an amino acid sequence according to SEQ ID NO: 54. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 321, or a CDR1 having one to two amino acid substitutions as compared to the sequence of SEQ ID NO: 321, (ii) a CDR2 having an amino acid sequence according to SEQ ID NO: 430, or a CDR2 having one to two amino acid substitutions as compared to the sequence of SEQ ID NO: 430, and (iii) a CDR3 having an amino acid sequence according to SEQ ID NO: 539, or a CDR3 having one to two amino acid substitutions as compared to the sequence of SEQ ID NO: 539; and a light chain variable region (VL) comprising (i) a CDR1 having an amino acid sequence according to SEQ ID NO: 648, or a CDR1 having one to two amino acid substitutions as compared to the sequence of SEQ ID NO: 648, (ii) a CDR2 having an amino acid sequence according to SEQ ID NO: 757, or a CDR2 having one to two amino acid substitutions as compared to the sequence of SEQ ID NO: 757, and (iii) a CDR3 having an amino acid sequence according to SEQ ID NO: 866, or a CDR3 having one to two amino acid substitutions as compared to the sequence of SEQ ID NO: 866. In some embodiments, the TL1A binding protein comprises a) a heavy chain variable region (VH) comprising (i) a CDR1 having an amino acid sequence according to SEQ ID NO: 321, (ii) a CDR2 having an amino acid sequence according to SEQ ID NO: 430, and (iii) a CDR3 having an amino acid sequence according to SEQ ID NO: 539; and b) a light chain variable region (VL) comprising (i) a CDR1 having an amino acid sequence according to SEQ ID NO: 648, (ii) a CDR2 having an amino acid sequence according to SEQ ID NO: 757, and (iii) a CDR3 having an amino acid sequence according to SEQ ID NO: 866. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 341, or a CDR1 having one to two amino acid substitutions as compared to the sequence of SEQ ID NO: 341, (ii) a CDR2 having an amino acid sequence according to SEQ ID NO: 450, or a CDR2 having one to two amino acid substitutions as compared to the sequence of SEQ ID NO: 450, and (iii) a CDR3 having an amino acid sequence according to SEQ ID NO: 559, or a CDR3 having one to two amino acid substitutions as compared to the sequence of SEQ ID NO: 559; and b) a light chain variable region (VL) comprising (i) a CDR1 having an amino acid sequence according to SEQ ID NO: 668, or a CDR1 having one to two amino acid substitutions as compared to the sequence of SEQ ID NO: 668, (ii) a CDR2 having an amino acid sequence according to SEQ ID NO: 777, or a CDR2 having one to two amino acid substitutions as compared to the sequence of SEQ ID NO: 777, and (iii) a CDR3 having an amino acid sequence according to SEQ ID NO: 886, or a CDR3 having one to two amino acid substitutions as compared to the sequence of SEQ ID NO: 886. In some embodiments, the TL1A binding protein comprises a) a heavy chain variable region (VH) comprising (i) a CDR1 having an amino acid sequence according to SEQ ID NO: 341, (ii) a CDR2 having an amino acid sequence according to SEQ ID NO: 450, and (iii) a CDR3 having an amino acid sequence according to SEQ ID NO: 559; and b) a light chain variable region (VL) comprising (i) a CDR1 having an amino acid sequence according to SEQ ID NO: 668, (ii) a CDR2 having an amino acid sequence according to SEQ ID NO: 777, and (iii) a CDR3 having an amino acid sequence according to SEQ ID NO: 886. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 345, or a CDR1 having one to two amino acid substitutions as compared to the sequence of SEQ ID NO: 345, (ii) a CDR2 having an amino acid sequence according to SEQ ID NO: 454, or a CDR2 having one to two amino acid substitutions as compared to the sequence of SEQ ID NO: 454, and (iii) a CDR3 having an amino acid sequence according to SEQ ID NO: 563, or a CDR3 having one to two amino acid substitutions as compared to the sequence of SEQ ID NO: 563; and b) a light chain variable region (VL) comprising (i) a CDR1 having an amino acid sequence according to SEQ ID NO: 672, or a CDR1 having one to two amino acid substitutions as compared to the sequence of SEQ ID NO: 672, (ii) a CDR2 having an amino acid sequence according to SEQ ID NO: 781, or a CDR2 having one to two amino acid substitutions as compared to the sequence of SEQ ID NO: 781, and (iii) a CDR3 having an amino acid sequence according to SEQ ID NO: 890, or a CDR3 having one to two amino acid substitutions as compared to the sequence of SEQ ID NO: 890. In some embodiments, the TL1A binding protein comprises a) a heavy chain variable region (VH) comprising (i) a CDR1 having an amino acid sequence according to SEQ ID NO: 345, (ii) a CDR2 having an amino acid sequence according to SEQ ID NO: 454, and (iii) a CDR3 having an amino acid sequence according to SEQ ID NO: 563; and b) a light chain variable region (VL) comprising (i) a CDR1 having an amino acid sequence according to SEQ ID NO: 672, (ii) a CDR2 having an amino acid sequence according to SEQ ID NO: 781, and (iii) a CDR3 having an amino acid sequence according to SEQ ID NO: 890. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 349, or a CDR1 having one to two amino acid substitutions as compared to the sequence of SEQ ID NO: 349, (ii) a CDR2 having an amino acid sequence according to SEQ ID NO: 458, or a CDR2 having one to two amino acid substitutions as compared to the sequence of SEQ ID NO: 458, and (iii) a CDR3 having an amino acid sequence according to SEQ ID NO: 567, or a CDR3 having one to two amino acid substitutions as compared to the sequence of SEQ ID NO: 567; and b) a light chain variable region (VL) comprising (i) a CDR1 having an amino acid sequence according to SEQ ID NO: 676, or a CDR1 having one to two amino acid substitutions as compared to the sequence of SEQ ID NO: 676, (ii) a CDR2 having an amino acid sequence according to SEQ ID NO: 785, or a CDR2 having one to two amino acid substitutions as compared to the sequence of SEQ ID NO: 785, and (iii) a CDR3 having an amino acid sequence according to SEQ ID NO: 894, or a CDR3 having one to two amino acid substitutions as compared to the sequence of SEQ ID NO: 894. In some embodiments, the TL1A binding protein comprises a) a heavy chain variable region (VH) comprising (i) a CDR1 having an amino acid sequence according to SEQ ID NO: 349, (ii) a CDR2 having an amino acid sequence according to SEQ ID NO: 458, and (iii) a CDR3 having an amino acid sequence according to SEQ ID NO: 567; and b) a light chain variable region (VL) comprising (i) a CDR1 having an amino acid sequence according to SEQ ID NO: 676, (ii) a CDR2 having an amino acid sequence according to SEQ ID NO: 785, and (iii) a CDR3 having an amino acid sequence according to SEQ ID NO: 894. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 351, or a CDR1 having one to two amino acid substitutions as compared to the sequence of SEQ ID NO: 351, (ii) a CDR2 having an amino acid sequence according to SEQ ID NO: 460, or a CDR2 having one to two amino acid substitutions as compared to the sequence of SEQ ID NO: 460; and (iii) a CDR3 having an amino acid sequence according to SEQ ID NO: 569, or a CDR3 having one to two amino acid substitutions as compared to the sequence of SEQ ID NO: 569; and b) a light chain variable region (VL) comprising (i) a CDR1 having an amino acid sequence according to SEQ ID NO: 678, or a CDR1 having one to two amino acid substitutions as compared to the sequence of SEQ ID NO: 678, (ii) a CDR2 having an amino acid sequence according to SEQ ID NO: 787, or a CDR2 having one to two amino acid substitutions as compared to the sequence of SEQ ID NO: 787; and (iii) a CDR3 having an amino acid sequence according to SEQ ID NO: 896, or a CDR3 having one to two amino acid substitutions as compared to the sequence of SEQ ID NO: 896. In some embodiments, the TL1A binding protein comprises a) a heavy chain variable region (VH) comprising (i) a CDR1 having an amino acid sequence according to SEQ ID NO: 351, (ii) a CDR2 having an amino acid sequence according to SEQ ID NO: 460; and (iii) a CDR3 having an amino acid sequence according to SEQ ID NO: 569; and b) a light chain variable region (VL) comprising (i) a CDR1 having an amino acid sequence according to SEQ ID NO: 678, (ii) a CDR2 having an amino acid sequence according to SEQ ID NO: 787; and (iii) a CDR3 having an amino acid sequence according to SEQ ID NO: 896. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 354, or a CDR1 having one to two amino acid substitutions as compared to the sequence of SEQ ID NO: 354, (ii) a CDR2 having an amino acid sequence according to SEQ ID NO: 463, or a CDR2 having one to two amino acid substitutions as compared to the sequence of SEQ ID NO: 463, and (iii) a CDR3 having an amino acid sequence according to SEQ ID NO: 572, or a CDR3 having one to two amino acid substitutions as compared to the sequence of SEQ ID NO: 572; and b) a light chain variable region (VL) comprising (i) a CDR1 having an amino acid sequence according to SEQ ID NO: 681, or a CDR1 having one to two amino acid substitutions as compared to the sequence of SEQ ID NO: 681, (ii) a CDR2 having an amino acid sequence according to SEQ ID NO: 790, or a CDR2 having one to two amino acid substitutions as compared to the sequence of SEQ ID NO: 790, and (iii) a CDR3 having an amino acid sequence according to SEQ ID NO: 899, or a CDR3 having one to two amino acid substitutions as compared to the sequence of SEQ ID NO: 899. In some embodiments, the TL1A binding protein comprises a) a heavy chain variable region (VH) comprising (i) a CDR1 having an amino acid sequence according to SEQ ID NO: 354, (ii) a CDR2 having an amino acid sequence according to SEQ ID NO: 463, and (iii) a CDR3 having an amino acid sequence according to SEQ ID NO: 572; and b) a light chain variable region (VL) comprising (i) a CDR1 having an amino acid sequence according to SEQ ID NO: 681, (ii) a CDR2 having an amino acid sequence according to SEQ ID NO: 790, and (iii) a CDR3 having an amino acid sequence according to SEQ ID NO: 899. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 365, or a CDR1 having one to two amino acid substitutions as compared to the sequence of SEQ ID NO: 365, (ii) a CDR2 having an amino acid sequence according to SEQ ID NO: 474, or a CDR2 having one to two amino acid substitutions as compared to the sequence of SEQ ID NO: 474, and (iii) a CDR3 having an amino acid sequence according to SEQ ID NO: 583, or a CDR3 having one to two amino acid substitutions as compared to the sequence of SEQ ID NO: 583; and a light chain variable region (VL) comprising (i) a CDR1 having an amino acid sequence according to SEQ ID NO: 692, or a CDR1 having one to two amino acid substitutions as compared to the sequence of SEQ ID NO: 692, (ii) a CDR2 having an amino acid sequence according to SEQ ID NO: 801, or a CDR2 having one to two amino acid substitutions as compared to the sequence of SEQ ID NO: 801, and (iii) a CDR3 having an amino acid sequence according to SEQ ID NO: 910, or a CDR3 having one to two amino acid substitutions as compared to the sequence of SEQ ID NO: 910. In some embodiments, the TL1A binding protein comprises a) a heavy chain variable region (VH) comprising (i) a CDR1 having an amino acid sequence according to SEQ ID NO: 365, (ii) a CDR2 having an amino acid sequence according to SEQ ID NO: 474, and (iii) a CDR3 having an amino acid sequence according to SEQ ID NO: 583; and b) a light chain variable region (VL) comprising (i) a CDR1 having an amino acid sequence according to SEQ ID NO: 692, (ii) a CDR2 having an amino acid sequence according to SEQ ID NO: 801, and (iii) a CDR3 having an amino acid sequence according to SEQ ID NO: 910. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 371, or a CDR1 having one to two amino acid substitutions as compared to the sequence of SEQ ID NO: 371, (ii) a CDR2 having an amino acid sequence according to SEQ ID NO: 480, or a CDR2 having one to two amino acid substitutions as compared to the sequence of SEQ ID NO: 480, and (iii) a CDR3 having an amino acid sequence according to SEQ ID NO: 589, or a CDR3 having one to two amino acid substitutions as compared to the sequence of SEQ ID NO: 589; and b) a light chain variable region (VL) comprising (i) a CDR1 having an amino acid sequence according to SEQ ID NO: 698, or a CDR1 having one to two amino acid substitutions as compared to the sequence of SEQ ID NO: 698, (ii) a CDR2 having an amino acid sequence according to SEQ ID NO: 807, or a CDR2 having one to two amino acid substitutions as compared to the sequence of SEQ ID NO: 807, and (iii) a CDR3 having an amino acid sequence according to SEQ ID NO: 916, or a CDR3 having one to two amino acid substitutions as compared to the sequence of SEQ ID NO: 916. In some embodiments, the TL1A binding protein comprises a) a heavy chain variable region (VH) comprising (i) a CDR1 having an amino acid sequence according to SEQ ID NO: 371, (ii) a CDR2 having an amino acid sequence according to SEQ ID NO: 480, and (iii) a CDR3 having an amino acid sequence according to SEQ ID NO: 589; and b) a light chain variable region (VL) comprising (i) a CDR1 having an amino acid sequence according to SEQ ID NO: 698, (ii) a CDR2 having an amino acid sequence according to SEQ ID NO: 807, and (iii) a CDR3 having an amino acid sequence according to SEQ ID NO: 916. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 372, or a CDR1 having one to two amino acid substitutions as compared to the sequence of SEQ ID NO: 372, (ii) a CDR2 having an amino acid sequence according to SEQ ID NO: 481, or a CDR2 having one to two amino acid substitutions as compared to the sequence of SEQ ID NO: 481, and (iii) a CDR3 having an amino acid sequence according to SEQ ID NO: 590, or a CDR3 having one to two amino acid substitutions as compared to the sequence of SEQ ID NO: 590; and b) a light chain variable region (VL) comprising (i) a CDR1 having an amino acid sequence according to SEQ ID NO: 699, or a CDR1 having one to two amino acid substitutions as compared to the sequence of SEQ ID NO: 699, (ii) a CDR2 having an amino acid sequence according to SEQ ID NO: 808, or a CDR2 20) having one to two amino acid substitutions as compared to the sequence of SEQ ID NO: 808, and (iii) a CDR3 having an amino acid sequence according to SEQ ID NO: 917, or a CDR3 having one to two amino acid substitutions as compared to the sequence of SEQ ID NO: 917. In some embodiments, the TL1A binding protein comprises a) a heavy chain variable region (VH) comprising (i) a CDR1 having an amino acid sequence according to SEQ ID NO: 372, (ii) a CDR2 having an amino acid sequence according to SEQ ID NO: 481, and (iii) a CDR3 having an amino acid sequence according to SEQ ID NO: 590; and b) a light chain variable region (VL) comprising (i) a CDR1 having an amino acid sequence according to SEQ ID NO: 699, (ii) a CDR2 having an amino acid sequence according to SEQ ID NO: 808, and (iii) a CDR3 having an amino acid sequence according to SEQ ID NO: 917. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 373, or a CDR1 having one to two amino acid substitutions as compared to the sequence of SEQ ID NO: 373, (ii) a CDR2 having an amino acid sequence according to SEQ ID NO: 482, or a CDR2 having one to two amino acid substitutions as compared to the sequence of SEQ ID NO: 482, and (iii) a CDR3 having an amino acid sequence according to SEQ ID NO: 591, or a CDR3 having one to two amino acid substitutions as compared to the sequence of SEQ ID NO: 591; and a light chain variable region (VL) comprising (i) a CDR1 having an amino acid sequence according to SEQ ID NO: 700, or a CDR1 having one to two amino acid substitutions as compared to the sequence of SEQ ID NO: 700, (ii) a CDR2 having an amino acid sequence according to SEQ ID NO: 809, or a CDR2 having one to two amino acid substitutions as compared to the sequence of SEQ ID NO: 809, and (iii) a CDR3 having an amino acid sequence according to SEQ ID NO: 918, or a CDR3 having one to two amino acid substitutions as compared to the sequence of SEQ ID NO: 918. In some embodiments, the TL1A binding protein comprises a) a heavy chain variable region (VH) comprising (i) a CDR1 having an amino acid sequence according to SEQ ID NO: 373, (ii) a CDR2 having an amino acid sequence according to SEQ ID NO: 482, and (iii) a CDR3 having an amino acid sequence according to SEQ ID NO: 591; and b) a light chain variable region (VL) comprising (i) a CDR1 having an amino acid sequence according to SEQ ID NO: 700, (ii) a CDR2 having an amino acid sequence according to SEQ ID NO: 809, and (iii) a CDR3 having an amino acid sequence according to SEQ ID NO: 918. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 388, or a CDR1 having one to two amino acid substitutions as compared to the sequence of SEQ ID NO: 388, (ii) a CDR2 having an amino acid sequence according to SEQ ID NO: 497, or a CDR2 having one to two amino acid substitutions as compared to the sequence of SEQ ID NO: 497, and (iii) a CDR3 having an amino acid sequence according to SEQ ID NO: 606, or a CDR3 having one to two amino acid substitutions as compared to the sequence of SEQ ID NO: 606; and a light chain variable region (VL) comprising (i) a CDR1 having an amino acid sequence according to SEQ ID NO: 715, or a CDR1 having one to two amino acid substitutions as compared to the sequence of SEQ ID NO: 715, (ii) a CDR2 having an amino acid sequence according to SEQ ID NO: 824, or a CDR2 having one to two amino acid substitutions as compared to the sequence of SEQ ID NO: 824, and (iii) a CDR3 having an amino acid sequence according to SEQ ID NO: 933, or a CDR3 having one to two amino acid substitutions as compared to the sequence of SEQ ID NO: 933. In some embodiments, the TL1A binding protein comprises a) a heavy chain variable region (VH) comprising (i) a CDR1 having an amino acid sequence according to SEQ ID NO: 388, (ii) a CDR2 having an amino acid sequence according to SEQ ID NO: 497, and (iii) a CDR3 having an amino acid sequence according to SEQ ID NO: 606; and b) a light chain variable region (VL) comprising (i) a CDR1 having an amino acid sequence according to SEQ ID NO: 715, (ii) a CDR2 having an amino acid sequence according to SEQ ID NO: 824, and (iii) a CDR3 having an amino acid sequence according to SEQ ID NO: 933. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 394, or a CDR1 having one to two amino acid substitutions as compared to the sequence of SEQ ID NO: 394, (ii) a CDR2 having an amino acid sequence according to SEQ ID NO: 503, or a CDR2 having one to two amino acid substitutions as compared to the sequence of SEQ ID NO: 503, and (iii) a CDR3 having an amino acid sequence according to SEQ ID NO: 612, or a CDR3 having one to two amino acid substitutions as compared to the sequence of SEQ ID NO: 612; and b) a light chain variable region (VL) comprising (i) a CDR1 having an amino acid sequence according to SEQ ID NO: 721, or a CDR1 having one to two amino acid substitutions as compared to the sequence of SEQ ID NO: 721, (ii) a CDR2 having an amino acid sequence according to SEQ ID NO: 830, or a CDR2 having one to two amino acid substitutions as compared to the sequence of SEQ ID NO: 830, and (iii) a CDR3 having an amino acid sequence according to SEQ ID NO: 939, or a CDR3 having one to two amino acid substitutions as compared to the sequence of SEQ ID NO: 939. In some embodiments, the TL1A binding protein comprises a) a heavy chain variable region (VH) comprising (i) a CDR1 having an amino acid sequence according to SEQ ID NO: 394, (ii) a CDR2 having an amino acid sequence according to SEQ ID NO: 503, and (iii) a CDR3 having an amino acid sequence according to SEQ ID NO: 612; and b) a light chain variable region (VL) comprising (i) a CDR1 having an amino acid sequence according to SEQ ID NO: 721, (ii) a CDR2 having an amino acid sequence according to SEQ ID NO: 830, and (iii) a CDR3 having an amino acid sequence according to SEQ ID NO: 939. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein is a TL1A binding protein, wherein the TL1A binding protein comprises a) a heavy chain variable region (VH) comprising (i) a CDR1 having an amino acid sequence according to SEQ ID NO: 400, or a CDR1 having one to two amino acid substitutions as compared to the sequence of SEQ ID NO: 400, (ii) a CDR2 having an amino acid sequence according to SEQ ID NO: 509, or a CDR2 having one to two amino acid substitutions as compared to the sequence of SEQ ID NO: 509, and (iii) a CDR3 having an amino acid sequence according to SEQ ID NO: 618, or a CDR3 having one to two amino acid substitutions as compared to the sequence of SEQ ID NO: 618; and b) a light chain variable region (VL) comprising (i) a CDR1 having an amino acid sequence according to SEQ ID NO: 727, or a CDR1 having one to two amino acid substitutions as compared to the sequence of SEQ ID NO: 727, (ii) a CDR2 having an amino acid sequence according to SEQ ID NO: 836, or a CDR2 having one to two amino acid substitutions as compared to the sequence of SEQ ID NO: 836, and (iii) a CDR3 having an amino acid sequence according to SEQ ID NO: 945, or a CDR3 having one to two amino acid substitutions as compared to the sequence of SEQ ID NO: 945. In some embodiments, the TL1A binding protein comprises a) a heavy chain variable region (VH) comprising (i) a CDR1 having an amino acid sequence according to SEQ ID NO: 400, (ii) a CDR2 having an amino acid sequence according to SEQ ID NO: 509, and (iii) a CDR3 having an amino acid sequence according to SEQ ID NO: 618; and b) a light chain variable region (VL) comprising (i) a CDR1 having an amino acid sequence according to SEQ ID NO: 727, (ii) a CDR2 having an amino acid sequence according to SEQ ID NO: 836, and (iii) a CDR3 having an amino acid sequence according to SEQ ID NO: 945. In some embodiments, the TL1A binding protein comprises an immunoglobin Fc domain. In some embodiments, the Fc domain comprises amino acid modifications L234A/L235A (LALA) and/or M252Y, S254T, and T256E (YTE).

Described herein, in some embodiments, are TL1A binding proteins comprising a) a heavy chain variable region (VH) comprising (i) a CDR1 having an amino acid sequence according to any one of SEQ ID NOs: 1-10 and 313-421, or having one to two amino acid substitutions as compared to any one of SEQ ID NOs: 1-10 and 313-421, (ii) a CDR2 having an amino acid sequence according to any one of SEQ ID NOs: 11-20 and 422-530, or having one to two amino acid substitutions as compared to any one of SEQ ID NOs: 11-20 and 422-530, and (iii) a CDR3 having an amino acid sequence according to any one of SEQ ID NOs: 21-30 and 531-639, or having one to two amino acid substitutions as compared to any one of SEQ ID NOS: 21-30 and 531-639; and b) a light chain variable region (VL) comprising (i) a CDR1 having an amino acid sequence according to any one of SEQ ID NOs: 31-40 and 640-748, or having one to two amino acid substitutions as compared to any one of SEQ ID NOs: 31-40 and 640-748, (ii) a CDR2 having an amino acid sequence according to any one of SEQ ID NOs: 41-50 and 749-857, or having one to two amino acid substitutions as compared to any one of SEQ ID NOs: 41-50 and 749-857, and (iii) a CDR3 having an amino acid sequence according to any one of SEQ ID NOs: 51-60 and 858-966 or having one to two amino acid substitutions as compared to any one of SEQ ID NOs: 51-60 and 858-966.

Described herein, in some embodiments, are TL1A binding proteins comprising a) a heavy chain variable region (VH) comprising (i) a CDR1 having an amino acid sequence according to any one of SEQ ID NOs: 1-10 and 313-421, (ii) a CDR2 having an amino acid sequence according to any one of SEQ ID NOs: 11-20 and 422-530, and (iii) a CDR3 having an amino acid sequence according to any one of SEQ ID NOs: 21-30 and 531-639; and b) a light chain variable region (VL) comprising (i) a CDR1 having an amino acid sequence according to any one of SEQ ID NOs: 31-40 and 640-748, (ii) a CDR2 having an amino acid sequence according to any one of SEQ ID NOs: 41-50 and 749-857, and (iii) a CDR3 having an amino acid sequence according to any one of SEQ ID NOs: 51-60 and 858-966.

Described herein, in some embodiments, are TL1A binding proteins comprising a) a heavy chain variable region (VH) comprising (i) a CDR1 having an amino acid sequence according to any one of CDRH1 sequences listed in TABLE 1.1 A, TABLE 1.1 B, and TABLE 1.1 C, (ii) a CDR2 having an amino acid sequence according to any one of CDRH2 sequences listed in TABLE 1.1 A, TABLE 1.1 B, and TABLE 1.1 C, and (iii) a CDR3 having an amino acid sequence according to any one of CDRH3 sequences listed in TABLE 1.1 A, TABLE 1.1 B, and TABLE 1.1 C; and b) a light chain variable region (VL) comprising (i) a CDR1 having an amino acid sequence according to any one of CDRL1 sequences listed in TABLE 1.1 A, TABLE 1.1 B, and TABLE 1.1 C, (ii) a CDR2 having an amino acid sequence according to any one of CDRL2 sequences listed in TABLE 1.1 A, TABLE 1.1 B, and TABLE 1.1 C, and (iii) a CDR3 having an amino acid sequence according to any one of CDRL3 sequences listed in TABLE 1.1 A, TABLE 1.1 B, and TABLE 1.1 C.

Further described herein, in some embodiments, are TL1A binding proteins comprising: a) a heavy chain variable region (VH) comprising (i) a CDR1 having an amino acid sequence according to any one of SEQ ID NOs: 1-10 and 313-421, (ii) a CDR2 having an amino acid sequence according to any one of SEQ ID NOs: 11-20 and 422-530, and (iii) a CDR3 having an amino acid sequence according to any one of SEQ ID NOs: 21-30 and 531-639; b) a light chain variable region (VL) comprising (i) a CDR1 having an amino acid sequence according to any one of SEQ ID NOs: 31-40 and 640-748, (ii) a CDR2 having an amino acid sequence according to any one of SEQ ID NOs: 41-50 and 749-857, and (iii) a CDR3 having an amino acid sequence according to any one of SEQ ID NOs: 51-60 and 858-966; and c) a modified Fc that extends half-life of the TL1A binding protein as compared to a TL1A binding protein that does not comprise the modified Fc.

In some embodiments, provided are TL1A binding antibodies, wherein the TL1A binding proteins specifically bind to a TL1A polypeptide comprising SEQ ID NO: 2493 or 2494. In some embodiments, provided are antibodies that bind to a TL1A polypeptide comprising SEQ ID NO: 2493 at any one of amino acid residues of Table 13 or Table 14. In some embodiments, provided are antibodies that bind to a TL1A polypeptide comprising SEQ ID NO: 2493 at any one of amino acid residues Lys243, Lys240, Thr239, Tyr238, Asp237, Val236, Leu235, Ser234, Ile233, Asp232, Met158, Arg156, Trp119, His118, Lys111, Phe110, His109, Gln108, Thr107, Pro106, Thr105, Gln104, Arg103, Val102, and Val101. In some embodiments, provided are antibodies that bind to a TL1A polypeptide comprising SEQ ID NO: 2493 at any one of amino acid residues Lys240, Thr239, Tyr238, Asp237, Val236, Leu235, Ser234, Gln104, and Arg103, Val102, and Val101

In some embodiments, the TL1A binding proteins comprises: a) a heavy chain variable region (VH) comprising (i) a CDR1 having an amino acid sequence according to any one of CDRH1 sequences listed in TABLE 1.1 A, TABLE 1.1 B, and TABLE 1.1 C, (ii) a CDR2 having an amino acid sequence according to any one of CDRH2 sequences listed in TABLE 1.1 A, TABLE 1.1 B, and TABLE 1.1 C, and (iii) a CDR3 having an amino acid sequence according to any one of CDRH3 sequences listed in TABLE 1.1 A, TABLE 1.1 B, and TABLE 1.1 C: b) a light chain variable region (VL) comprising (i) a CDR1 having an amino acid sequence according to any one of CDRL1 sequences listed in TABLE 1.1 A, TABLE 1.1 B, and TABLE 1.1 C, (ii) a CDR2 having an amino acid sequence according to any one of CDRL2 sequences listed in TABLE 1.1 A, TABLE 1.1 B, and TABLE 1.1 C, and (iii) a CDR3 having an amino acid sequence according to any one of CDRL3 sequences listed in TABLE 1.1 A, TABLE 1.1 B, and TABLE 1.1 C; and c) a modified Fc that extends half-life of the TL1A binding protein as compared to a TL1A binding protein that does not comprise the modified Fc.

Described herein, in some embodiments, are TL1A binding proteins comprising a) a heavy chain variable region (VH) comprising (i) a CDR1 having an amino acid sequence according to any one of CDRH1 sequences listed in TABLE 1.2 A, TABLE 1.2 B, and TABLE 1.2 C, (ii) a CDR2 having an amino acid sequence according to any one of CDRH2 sequences listed in TABLE 1.2 A, TABLE 1.2 B, and TABLE 1.2 C, and (iii) a CDR3 having an amino acid sequence according to any one of CDRH3 sequences listed in TABLE 1.2 A, TABLE 1.2 B, and TABLE 1.2 C; and b) a light chain variable region (VL) comprising (i) a CDR1 having an amino acid sequence according to any one of CDRL1 sequences listed in TABLE 1.2 A, TABLE 1.2 B, and TABLE 1.2 C, (ii) a CDR2 having an amino acid sequence according to any one of CDRL2 sequences listed in TABLE 1.2 A, TABLE 1.2 B, and TABLE 1.2 C, and (iii) a CDR3 having an amino acid sequence according to any one of CDRL3 sequences listed in TABLE 1.2 A, TABLE 1.2 B, and TABLE 1.2 C.

Further described herein, in some embodiments, are TL1A binding proteins comprising: a) a heavy chain variable region (VH) comprising (i) a CDR1 having an amino acid sequence according to any one of CDRH1 sequences listed in TABLE 1.2 A, TABLE 1.2 B, and TABLE 1.2 C, (ii) a CDR2 having an amino acid sequence according to any one of CDRH2 sequences listed in TABLE 1.2 A, TABLE 1.2 B, and TABLE 1.2 C, and (iii) a CDR3 having an amino acid sequence according to any one of CDRH3 sequences listed in TABLE 1.2 A. TABLE 1.2 B, and TABLE 1.2 C: b) a light chain variable region (VL) comprising (i) a CDR1 having an amino acid sequence according to any one of CDRL1 sequences listed in TABLE 1.2 A, TABLE 1.2 B, and TABLE 1.2 C, (ii) a CDR2 having an amino acid sequence according to any one of CDRL2 sequences listed in TABLE 1.2 A, TABLE 1.2 B, and TABLE 1.2 C, and (iii) a CDR3 having an amino acid sequence according to any one of CDRL3 sequences listed in TABLE 1.2 A, TABLE 1.2 B, and TABLE 1.2 C; and c) a modified Fc that extends half-life of the TL1A binding protein as compared to a TL1A binding protein that does not comprise the modified Fc.

Described herein, in some embodiments, are TL1A binding proteins comprising a) a heavy chain variable region (VH) comprising (i) a CDR1 having an amino acid sequence according to any one of CDRH1 sequences listed in TABLE 1.3 A, TABLE 1.3 B, and TABLE 1.3 C, (ii) a CDR2 having an amino acid sequence according to any one of CDRH2 sequences listed in TABLE 1.3 A, TABLE 1.3 B, and TABLE 1.3 C, and (iii) a CDR3 having an amino acid sequence according to any one of CDRH3 sequences listed in TABLE 1.3 A, TABLE 1.3 B, and TABLE 1.3 C; and b) a light chain variable region (VL) comprising (i) a CDR1 having an amino acid sequence according to any one of CDRL1 sequences listed in TABLE 1.3 A, TABLE 1.3 B, and TABLE 1.3 C, (ii) a CDR2 having an amino acid sequence according to any one of CDRL2 sequences listed in TABLE 1.3 A, TABLE 1.3 B, and TABLE 1.3 C, and (iii) a CDR3 having an amino acid sequence according to any one of CDRL3 sequences listed in TABLE 1.3 A, TABLE 1.3 B, and TABLE 1.3 C.

Further described herein, in some embodiments, are TL1A binding proteins comprising: a) a heavy chain variable region (VH) comprising (i) a CDR1 having an amino acid sequence according to any one of CDRH1 sequences listed in TABLE 1.3 A, TABLE 1.3 B, and TABLE 1.3 C, (ii) a CDR2 having an amino acid sequence according to any one of CDRH2 sequences listed in TABLE 1.3 A, TABLE 1.3 B, and TABLE 1.3 C, and (iii) a CDR3 having an amino acid sequence according to any one of CDRH3 sequences listed in TABLE 1.3 A, TABLE 1.3 B, and TABLE 1.3 C; b) a light chain variable region (VL) comprising (i) a CDR1 having an amino acid sequence according to any one of CDRL1 sequences listed in TABLE 1.3 A, TABLE 1.3 B, and TABLE 1.3 C, (ii) a CDR2 having an amino acid sequence according to any one of CDRL2 sequences listed in TABLE 1.3 A, TABLE 1.3 B, and TABLE 1.3 C, and (iii) a CDR3 having an amino acid sequence according to any one of CDRL3 sequences listed in TABLE 1.3 A, TABLE 1.3 B, and TABLE 1.3 C; and c) a modified Fc that extends half-life of the TL1A binding protein as compared to a TL1A binding protein that does not comprise the modified Fc.

Described herein, in some embodiments, are TL1A binding proteins comprising a VH comprising a sequence having at least 80% sequence identity to the amino acid sequence of any one of VH sequences listed in TABLE 2.1 and TABLE 2.2, and a VL comprising a sequence having at least 80% sequence identity to the amino acid sequence of any one of VL sequences listed in TABLE 2.1 and TABLE 2.2. In some embodiments, the TL1A binding protein comprises a VH comprising a sequence having at least 85% sequence identity to the amino acid sequence of any one of VH sequences listed in TABLE 2.1 and TABLE 2.2, and a VL comprising a sequence having at least 85% sequence identity to the amino acid sequence of any one of VL sequences listed in TABLE 2.1 and TABLE 2.2. In some embodiments, the TL1A binding protein comprises a VH comprising a sequence having at least 90% sequence identity to the amino acid sequence of any one of VH sequences listed in TABLE 2.1 and TABLE 2.2, and a VL comprising a sequence having at least 90% sequence identity to the amino acid sequence of any one of VL sequences listed in TABLE 2.1 and TABLE 2.2. In some embodiments, the TL1A binding protein comprises a VH comprising a sequence having at least 95% sequence identity to the amino acid sequence of any one of VH sequences listed in TABLE 2.1 and TABLE 2.2, and a VL comprising a sequence having at least 95% sequence identity to the amino acid sequence of any one of VL sequences listed in TABLE 2.1 and TABLE 2.2. In some embodiments, the TL1A binding protein comprises a VH comprising a sequence having at least 96% sequence identity to the amino acid sequence of any one of VH sequences listed in TABLE 2.1 and TABLE 2.2, and a VL comprising a sequence having at least 96% sequence identity to the amino acid sequence of any one of VL sequences listed in TABLE 2.1 and TABLE 2.2. In some embodiments, the TL1A binding protein comprises a VH comprising a sequence having at least 97% sequence identity to the amino acid sequence of any one of VH sequences listed in TABLE 2.1 and TABLE 2.2, and a VL comprising a sequence having at least 97% sequence identity to the amino acid sequence of any one of VL sequences listed in TABLE 2.1 and TABLE 2.2. In some embodiments, the TL1A binding protein comprises a VH comprising a sequence having at least 98% sequence identity to the amino acid sequence of any one of VH sequences listed in TABLE 2.1 and TABLE 2.2, and a VL comprising a sequence having at least 98% sequence identity to the amino acid sequence of any one of VL sequences listed in TABLE 2.1 and TABLE 2.2. In some embodiments, the TL1A binding protein comprises a VH comprising a sequence having at least 99% sequence identity to the amino acid sequence of any one of VH sequences listed in TABLE 2.1 and TABLE 2.2, and a VL comprising a sequence having at least 99% sequence identity to the amino acid sequence of any one of VL sequences listed in TABLE 2.1 and TABLE 2.2.

In some embodiments, the TL1A binding protein comprises a Fc domain. In some embodiments, the Fc domain is an IgG1, IgG2 or IgG4 immunoglobulin Fc domain. In some embodiments, the Fc domain is an IgG1 immunoglobulin domain. In some embodiments, the Fc domain is an IgG2 immunoglobulin domain. In some embodiments, the Fc domain is an IgG4 immunoglobulin domain. In some embodiments, the Fc domain amino acid comprises amino acid modifications L234A/L235A (LALA) and/or M252Y, S254T, and T256E (YTE). In some embodiments, the TL1A binding protein is a TL1A binding antibody.

Further described herein, in, are TL1A binding antibodies, wherein the TL1A binding antibodies specifically bind to an epitope of TL1A and comprises a Fc domain comprising amino acid modifications L234A/L235A (LALA) and/or M252Y, S254T, and T256E (YTE).

Described herein, in some embodiments, are TL1A binding proteins, comprising: a) a heavy chain variable region (VH) comprising (i) a CDR1 having an amino acid sequence according to CDRH1 sequences listed in TABLE 1.1 A, (ii) a CDR2 having an amino acid sequence according to CDRH2 sequences listed in TABLE 1.1 A, and (iii) a CDR3 having an amino acid sequence according to CDRH3 sequences listed in TABLE 1.1 A; and b) a light chain variable region (VL) comprising (i) a CDR1 having an amino acid sequence according to CDRL1 sequences listed in TABLE 1.1 A, (ii) a CDR2 having an amino acid sequence according to CDRL2 sequences listed in TABLE 1.1 A, and (iii) a CDR3 having an amino acid sequence according to CDRL3 sequences listed in TABLE 1.1 A. In some embodiments, the VH comprises a sequence having at least 80% sequence identity to the amino acid sequence of any one of VH sequences listed in TABLE 2.2 and the VL comprises a sequence having at least 80% sequence identity to the amino acid sequence of any one of VL sequences listed in TABLE 2.2. In some embodiments, the TL1A binding protein comprises a Fc domain comprising amino acid modifications L234A/L235A (LALA) and/or M252Y, S254T, and T256E (YTE).

Described herein, in some embodiments, are TL1A binding proteins, comprising: a) a heavy chain variable region (VH) comprising (i) a CDR1 having an amino acid sequence according to CDRH1 sequences listed in TABLE 1.2 A, (ii) a CDR2 having an amino acid sequence according to CDRH2 sequences listed in TABLE 1.2 A, and (iii) a CDR3 having an amino acid sequence according to CDRH3 sequences listed in TABLE 1.2 A; and b) a light chain variable region (VL) comprising (i) a CDR1 having an amino acid sequence according to CDRL1 sequences listed in TABLE 1.2 A, (ii) a CDR2 having an amino acid sequence according to CDRL2 sequences listed in TABLE 1.2 A, and (iii) a CDR3 having an amino acid sequence according to CDRL3 sequences listed in TABLE 1.2 A. In some embodiments, the VH comprises a sequence having at least 80% sequence identity to the amino acid sequence of any one of VH sequences listed in TABLE 2.2 and the VL comprises a sequence having at least 80% sequence identity to the amino acid sequence of any one of VL sequences listed in TABLE 2.2. In some embodiments, the TL1A binding protein comprises a Fc domain comprising amino acid modifications L234A/L235A (LALA) and/or M252Y, S254T, and T256E (YTE).

Described herein, in some embodiments, are TL1A binding proteins, comprising: a) a heavy chain variable region (VH) comprising (i) a CDR1 having an amino acid sequence according to CDRH1 sequences listed in TABLE 1.3 A, (ii) a CDR2 having an amino acid sequence according to CDRH2 sequences listed in TABLE 1.3 A, and (iii) a CDR3 having an amino acid sequence according to CDRH3 sequences listed in TABLE 1.3 A; and b) a light chain variable region (VL) comprising (i) a CDR1 having an amino acid sequence according to CDRL1 sequences listed in TABLE 1.3 A, (ii) a CDR2 having an amino acid sequence according to CDRL2 sequences listed in TABLE 1.3 A, and (iii) a CDR3 having an amino acid sequence according to CDRL3 sequences listed in TABLE 1.3 A. In some embodiments, the VH comprises a sequence having at least 80% sequence identity to the amino acid sequence of any one of VH sequences listed in TABLE 2.2 and the VL comprises a sequence having at least 80% sequence identity to the amino acid sequence of any one of VL sequences listed in TABLE 2.2. In some embodiments, the TL1A binding protein comprises a Fc domain comprising amino acid modifications L234A/L235A (LALA) and/or M252Y, S254T, and T256E (YTE).

Described herein, in some embodiments, are TL1A binding proteins, comprising: a) a heavy chain variable region (VH) comprising (i) a CDR1 having an amino acid sequence according to CDRH1 sequences listed in TABLE 1.1 B, (ii) a CDR2 having an amino acid sequence according to CDRH2 sequences listed in TABLE 1.1 B, and (iii) a CDR3 having an amino acid sequence according to CDRH3 sequences listed in TABLE 1.1 B; and b) a light chain variable region (VL) comprising (i) a CDR1 having an amino acid sequence according to CDRL1 sequences listed in TABLE 1.1 B, (ii) a CDR2 having an amino acid sequence according to CDRL2 sequences listed in TABLE 1.1 B, and (iii) a CDR3 having an amino acid sequence according to CDRL3 sequences listed in TABLE 1.1 B. In some embodiments, the VH comprises a sequence having at least 80% sequence identity to the amino acid sequence of any one of VH sequences listed in TABLE 2.2 and the VL comprises a sequence having at least 80% sequence identity to the amino acid sequence of any one of VL sequences listed in TABLE 2.2. In some embodiments, the TL1A binding protein comprises a Fc domain comprising amino acid modifications L234A/L235A (LALA) and/or M252Y, S254T, and T256E (YTE).

Described herein, in some embodiments, are TL1A binding proteins, comprising: a) a heavy chain variable region (VH) comprising (i) a CDR1 having an amino acid sequence according to CDRH1 sequences listed in TABLE 1.2 B, (ii) a CDR2 having an amino acid sequence according to CDRH2 sequences listed in TABLE 1.2 B, and (iii) a CDR3 having an amino acid sequence according to CDRH3 sequences listed in TABLE 1.2 B; and b) a light chain variable region (VL) comprising (i) a CDR1 having an amino acid sequence according to CDRL1 sequences listed in TABLE 1.2 B, (ii) a CDR2 having an amino acid sequence according to CDRL2 sequences listed in TABLE 1.2 B, and (iii) a CDR3 having an amino acid sequence according to CDRL3 sequences listed in TABLE 1.2 B. In some embodiments, the VH comprises a sequence having at least 80% sequence identity to the amino acid sequence of any one of VH sequences listed in TABLE 2.2 and the VL comprises a sequence having at least 80% sequence identity to the amino acid sequence of any one of VL sequences listed in TABLE 2.2. In some embodiments, the TL1A binding protein comprises a Fc domain comprising amino acid modifications L234A/L235A (LALA) and/or M252Y, S254T, and T256E (YTE).

Described herein, in some embodiments, are TL1A binding proteins, comprising: a) a heavy chain variable region (VH) comprising (i) a CDR1 having an amino acid sequence according to CDRH1 sequences listed in TABLE 1.3 B, (ii) a CDR2 having an amino acid sequence according to CDRH2 sequences listed in TABLE 1.3 B, and (iii) a CDR3 having an amino acid sequence according to CDRH3 sequences listed in TABLE 1.3 B; and b) a light chain variable region (VL) comprising (i) a CDR1 having an amino acid sequence according to CDRL1 sequences listed in TABLE 1.3 B, (ii) a CDR2 having an amino acid sequence according to CDRL2 sequences listed in TABLE 1.3 B, and (iii) a CDR3 having an amino acid sequence according to CDRL3 sequences listed in TABLE 1.3 B. In some embodiments, the VH comprises a sequence having at least 80% sequence identity to the amino acid sequence of any one of VH sequences listed in TABLE 2.2 and the VL comprises a sequence having at least 80% sequence identity to the amino acid sequence of any one of VL sequences listed in TABLE 2.2. In some embodiments, the TL1A binding protein comprises a Fc domain comprising amino acid modifications L234A/L235A (LALA) and/or M252Y, S254T, and T256E (YTE).

Described herein, in some embodiments, are TL1A binding proteins, comprising: a) a heavy chain variable region (VH) comprising (i) a CDR1 having an amino acid sequence according to CDRH1 sequences listed in TABLE 1.1 C, (ii) a CDR2 having an amino acid sequence according to CDRH2 sequences listed in TABLE 1.1 C, and (iii) a CDR3 having an amino acid sequence according to CDRH3 sequences listed in TABLE 1.1 C; and b) a light chain variable region (VL) comprising (i) a CDR1 having an amino acid sequence according to CDRL1 sequences listed in TABLE 1.1 C, (ii) a CDR2 having an amino acid sequence according to CDRL2 sequences listed in TABLE 1.1 C, and (iii) a CDR3 having an amino acid sequence according to CDRL3 sequences listed in TABLE 1.1 C. In some embodiments, the VH comprises a sequence having at least 80% sequence identity to the amino acid sequence of any one of VH sequences listed in TABLE 2.2 and the VL comprises a sequence having at least 80% sequence identity to the amino acid sequence of any one of VL sequences listed in TABLE 2.2. In some embodiments, the TL1A binding protein comprises a Fc domain comprising amino acid modifications L234A/L235A (LALA) and/or M252Y, S254T, and T256E (YTE).

Described herein, in some embodiments, are TL1A binding proteins, comprising: a) a heavy chain variable region (VH) comprising (i) a CDR1 having an amino acid sequence according to CDRH1 sequences listed in TABLE 1.2 C, (ii) a CDR2 having an amino acid sequence according to CDRH2 sequences listed in TABLE 1.2 C, and (iii) a CDR3 having an amino acid sequence according to CDRH3 sequences listed in TABLE 1.2 C; and b) a light chain variable region (VL) comprising (i) a CDR1 having an amino acid sequence according to CDRL1 sequences listed in TABLE 1.2 C, (ii) a CDR2 having an amino acid sequence according to CDRL2 sequences listed in TABLE 1.2 C, and (iii) a CDR3 having an amino acid sequence according to CDRL3 sequences listed in TABLE 1.2 C. In some embodiments, the VH comprises a sequence having at least 80% sequence identity to the amino acid sequence of any one of VH sequences listed in TABLE 2.2 and the VL comprises a sequence having at least 80% sequence identity to the amino acid sequence of any one of VL sequences listed in TABLE 2.2. In some embodiments, the TL1A binding protein comprises a Fc domain comprising amino acid modifications L234A/L235A (LALA) and/or M252Y, S254T, and T256E (YTE).

Described herein, in some embodiments, are TL1A binding proteins, comprising: a) a heavy chain variable region (VH) comprising (i) a CDR1 having an amino acid sequence according to CDRH1 sequences listed in TABLE 1.3 C, (ii) a CDR2 having an amino acid sequence according to CDRH2 sequences listed in TABLE 1.3 C, and (iii) a CDR3 having an amino acid sequence according to CDRH3 sequences listed in TABLE 1.3 C; and b) a light chain variable region (VL) comprising (i) a CDR1 having an amino acid sequence according to CDRL1 sequences listed in TABLE 1.3 C, (ii) a CDR2 having an amino acid sequence according to CDRL2 sequences listed in TABLE 1.3 C, and (iii) a CDR3 having an amino acid sequence according to CDRL3 sequences listed in TABLE 1.3 C. In some embodiments, the VH comprises a sequence having at least 80% sequence identity to the amino acid sequence of any one of VH sequences listed in TABLE 2.2 and the VL comprises a sequence having at least 80% sequence identity to the amino acid sequence of any one of VL sequences listed in TABLE 2.2. In some embodiments, the TL1A binding protein comprises a Fc domain comprising amino acid modifications L234A/L235A (LALA) and/or M252Y, S254T, and T256E (YTE).

Described herein, in some embodiments, are TL1A binding proteins comprising: a) a heavy chain variable region (VH) comprising (i) a CDR1 having an amino acid sequence according to any one of CDRH1 sequences listed in TABLE 1.1 A, TABLE 1.1 B, and TABLE 1.1 C, (ii) a CDR2 having an amino acid sequence according to any one of CDRH2 sequences listed in TABLE 1.1 A, TABLE 1.1 B, and TABLE 1.1 C, and (iii) a CDR3 having an amino acid sequence according to any one of CDRH3 sequences listed in TABLE 1.1 A, TABLE 1.1 B, and TABLE 1.1 C: b) a light chain variable region (VL) comprising (i) a CDR1 having an amino acid sequence according to any one of CDRL1 sequences listed in TABLE 1.1 A, TABLE 1.1 B, and TABLE 1.1 C, (ii) a CDR2 having an amino acid sequence according to any one of CDRL2 sequences listed in TABLE 1.1 A, TABLE 1.1 B, and TABLE 1.1 C, and (iii) a CDR3 having an amino acid sequence according to any one of CDRL3 sequences listed in TABLE 1.1 A, TABLE 1.1 B, and TABLE 1.1 C; and c) a modified Fc that extends half-life of the TL1A binding protein as compared to a TL1A binding protein that does not comprise the modified Fc.

Described herein, in some embodiments, are TL1A binding proteins, wherein the TL1A binding protein specifically binds to an epitope of TL1A and comprises a Fc domain comprising amino acid modifications L234A/L235A (LALA) and/or M252Y, S254T, and T256E (YTE). In some embodiments, the TL1A binding protein binds TL1A with a $K_D$ less than about 0.5 nanomolar (nM). In some embodiments, the TL1A binding protein binds TL1A with a $K_D$ less than about 0.4 nanomolar (nM). In some embodiments, the TL1A binding protein comprises a binding affinity to TL1A at least 2-fold more than a binding affinity of a comparator antibody to TL1A. In some embodiments, the TL1A binding protein is a TL1A binding antibody. In some embodiments, the TL1A binding protein reduces TL1A-induced apoptosis by at least 2-fold more than a comparator antibody.

In some embodiments, are TL1A binding antibodies, wherein the TL1A binding proteins specifically bind to a TL1A polypeptide comprising SEQ ID NO: 2493 or 2494.

In some the TL1A binding protein specifically binds to an epitope of TL1A. In some embodiments, the TL1A binding protein specifically binds to a TL1A polypeptide comprising SEQ ID NO: 2493 at any one of amino acid residues of Table 12. In some embodiments, the TL1A binding protein specifically binds to a TL1A polypeptide comprising SEQ ID NO: 2493 at any one of amino acid residues of Table 13. In some embodiments, the TL1A binding protein specifically binds to a TL1A polypeptide comprising SEQ ID NO: 2493 at any one of amino acid residues of Table 14. In some embodiments, the TL1A antigen binding protein is an antibody.

In some embodiments, the TL1A binding protein specifically to the TL1A polypeptide at least at 2 or more amino acid residues of Table 12. In some embodiments, the TL1A binding protein specifically binds to a TL1A polypeptide comprising SEQ ID NO: 2493 at least at 2 or more amino acid residues of Val 101, Val 102, Arg 103, Gln 104, Thr 105, Pro 106, Gln 108, His 118, Glu 120, Glu 122, Leu 123, Gly 124, Asn 136, Lys 137, Arg 156, Gly 157, Met 158, Ser 234, Tyr 238, Thr 239. In some embodiments, the TL1A binding protein specifically binds to a TL1A polypeptide comprising SEQ ID NO: 2493 at least at 2 or more amino acid residues of Val 102, Arg 103, Gln 104, Glu 120, Glu 122, Leu 123, and Arg 156. In some embodiments, the TL1A binding protein specifically binds to a TL1A polypeptide comprising SEQ ID NO: 2493 at least at 2 or more amino acid residues of Val 102, Arg 103, Gln 104, Glu 120, Glu 122, Leu 123, Arg 156 and Tyr 238.

In some embodiments, the TL1A binding protein specifically binds to a TL1A polypeptide comprising SEQ ID NO: 2493 at least at 2 or more amino acid residues of Table 13. In some embodiments, the TL1A binding protein specifically binds to a TL1A polypeptide comprising SEQ ID NO: 2493 at least at 2 or more amino acid residues of Table 14. In some embodiments, the TL1A binding protein specifically binds to a TL1A polypeptide comprising SEQ ID NO: 2493 at least at 2 or more amino acid residues of Val 101, Val 102, Arg 103, Gln 104, Thr 105, Pro 106, Thr 107, Gln 108, His 109, Phe 110, Lys 111, Leu 117, His 118, Trp 119, Arg 156, Asp 232, Ile 233, Ser 234, Leu 235, Val 236, Asp 237, Tyr 238, Thr 239, Lys 240. In some embodiments, the TL1A binding protein specifically binds to a TL1A polypeptide comprising SEQ ID NO: 2493 at least at 2 or more amino acid residues of Table 14. In some embodiments, the TL1A binding protein specifically binds to a TL1A polypeptide comprising SEQ ID NO: 2493 at least at 2 or more amino acid residues of Arg103, Gln104, Arg 156, Ser234, Leu235, Val236, Asp237, Tyr238, Thr239, and Lys240.

In some embodiments the amino acid residue of the TL1A epitope bind the paratope of the antibody with a distance of 6 Angstroms or less, 5 Angstroms or less, 4 Angstroms or less, 3 Angstroms or less, or 2 Angstroms or less.

TABLE 1

TL1A SEQUENCES

| Name | SEQ ID NO. | Sequence |
|---|---|---|
| Human TL1A (TNF15)-1 | 2493 | MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL |
| Human TL1A (TNF15)-2 | 2494 | MQLTKGRLHFSHPLSHTKHISPFVTDAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL |

TABLE 1.1 A

AMINO ACID SEQUENCES OF EXEMPLARY CDRS OF ANTIBODY 1-4
Kabat Numbering (EU index)

| Antibody | CDRH1 SEQ ID NO | CDRH1 | CDRH2 SEQ ID NO | CDRH2 | CDRH3 SEQ ID NO | CDRH3 |
|---|---|---|---|---|---|---|
| Antibody 1 | 1 | SYAMH | 11 | VVSYEGSQNYYADSVKG | 21 | LESAYYFDY |
| Antibody 2 | 2 | SYYWS | 12 | LIYYSGSTNYNPSLKS | 22 | ADVVTIDY |
| Antibody 3 | 3 | TYNMN | 13 | SIHSSSNYLYYADSVKG | 23 | DRAMVDFDY |
| Antibody 4 | 4 | SNSATWN | 14 | RTYYRSKWYNDYAVSVKS | 24 | EAVGPTKDFDY |
| **Antibody** | **CDRL1 SEQ ID NO** | **CDRL1** | **CDRL2 SEQ ID NO** | **CDRL2** | **CDRL3 SEQ ID NO** | **CDRL3** |
| Antibody 1 | 31 | RSSQSLLYSNGYNSLD | 41 | LGSNRAS | 51 | MQALQTPYT |
| Antibody 2 | 32 | RASQTISSYFN | 42 | AASSLQS | 52 | QQSYSTPIT |

TABLE 1.1 A-continued

AMINO ACID SEQUENCES OF EXEMPLARY CDRS OF ANTIBODY 1-4
Kabat Numbering (EU index)

| | | | | | | |
|---|---|---|---|---|---|---|
| Antibody 3 | 33 | RASQSIST YLN | 43 | AASSLQS | 53 | QQSYST PLT |
| Antibody 4 | 34 | RASQSFS SYLN | 44 | AASSLQS | 54 | QQSYFT PRT |

TABLE 1.2 A

AMINO ACID SEQUENCES OF EXEMPLARY CDRS OF ANTIBODY 1-4
Chothia Numbering

| Antibody | CDRH1 SEQ ID NO | CDRH1 | CDRH2 SEQ ID NO | CDRH2 | CDRH3 SEQ ID NO | CDRH3 |
|---|---|---|---|---|---|---|
| Antibody 1 | 61 | GFTFSSY | 71 | SYEGSQ | 81 | ESAYYFD |
| Antibody 2 | 62 | GGSISSY | 72 | YYSGS | 82 | DVVTID |
| Antibody 3 | 63 | GFTFSTY | 73 | HSSSNY | 83 | RAMVDFD |
| Antibody 4 | 64 | GDSVSSNSA | 74 | YYRSKWY | 84 | AVGPTKDFD |

| Antibody | CDRL1 SEQ ID NO | CDRL1 | CDRL2 SEQ ID NO | CDRL2 | CDRL3 SEQ ID NO | CDRL3 |
|---|---|---|---|---|---|---|
| Antibody 1 | 91 | SQSLLYSNG YNS | | LGS | 111 | ALQTPY |
| Antibody 2 | 92 | SQTISSY | | AAS | 112 | SYSTPI |
| Antibody 3 | 93 | SQSISTY | | AAS | 113 | SYSTPL |
| Antibody 4 | 94 | SQSFSSY | | AAS | 114 | SYFTPR |

TABLE 1.3 A

AMINO ACID SEQUENCES OF EXEMPLARY CDRS OF ANTIBODY 1-4
IMGT Numbering

| Antibody | CDRH1 SEQ ID NO | CDRH1 | CDRH2 SEQ ID NO | CDRH2 | CDRH3 SEQ ID NO | CDRH3 |
|---|---|---|---|---|---|---|
| Antibody 1 | 121 | GFTFSS YA | 131 | VSYEGSQN | 141 | ANLESAY YFDY |
| Antibody 2 | 122 | GGSISS YY | 132 | IYYSGST | 142 | ARADVV TIDY |
| Antibody 3 | 123 | GFTFST YN | 133 | IHSSSNYL | 143 | ATDRAMV DFDY |
| Antibody 4 | 124 | GDSVSS NSAT | 134 | TYYRSKWYN | 144 | AREAVGPTK DFDY |

TABLE 1.3 A-continued

AMINO ACID SEQUENCES OF EXEMPLARY CDRS OF ANTIBODY 1-4
IMGT Numbering

| Antibody | CDRL1 SEQ ID NO | CDRL1 | CDRL2 SEQ ID NO | CDRL2 | CDRL3 SEQ ID NO | CDRL3 |
|---|---|---|---|---|---|---|
| Antibody 1 | 151 | QSLLYSN GYNS | | LGS | 171 | MQALQ TPYT |
| Antibody 2 | 152 | QTISSY | | AAS | 172 | QQSYST PIT |
| Antibody 3 | 153 | QSISTY | | AAS | 173 | QQSYST PLT |
| Antibody 4 | 154 | QSFSSY | | AAS | 174 | QQSYFT PRT |

TABLE 1.1 B

AMINO ACID SEQUENCES OF EXEMPLARY CDRS OF ANTIBODY 5-10
Kabat Numbering (EU index)

| Antibody | CDRH1 SEQ ID NO | CDRH1 | CDRH2 SEQ ID NO | CDRH2 | CDRH3 SEQ ID NO | CDRH3 |
|---|---|---|---|---|---|---|
| Antibody 5 | 5 | NVWMN | 15 | LIKSKTDAGTT DYAAPVKG | 25 | DRGWG-ENY |
| Antibody 6 | 6 | NVWMN | 16 | RIKSKIDAGTT DYVAPVKG | 26 | DRGWG-ENY |
| Antibody 7 | 7 | NAWMS | 17 | RIKSKIDAGTT DYAAPVKG | 27 | DLGWG-ENY |
| Antibody 8 | 8 | NAWMS | 18 | RIKSKIDAGTT DYAAPVKG | 28 | DLGWG-ENY |
| Antibody 9 | 9 | NAWMT | 19 | RIKSKIDAGTT DYAAPVKG | 29 | DLGWG-ENY |
| Antibody 10 | 10 | NAWMT | 20 | RIKSKIDAGTT DYAAPVKG | 30 | DLGWG-ENY |

| Antibody | CDRL1 SEQ ID NO | CDRL1 | CDRL2 SEQ ID NO | CDRL2 | CDRL3 SEQ ID NO | CDRL3 |
|---|---|---|---|---|---|---|
| Antibody 5 | 35 | RASQIFSSSY LV | 45 | GASSRAT | 55 | QQYGN SPYT |
| Antibody 6 | 36 | RASQSVSSS YLV | 46 | GASSRAT | 56 | QQYGG SPYT |
| Antibody 7 | 37 | RASQSISRSY LV | 47 | GASSRAT | 57 | HQYGS SPYT |
| Antibody 8 | 38 | RASQRVSSS YLV | 48 | GASSRAT | 58 | QQYGS SPYT |
| Antibody 9 | 39 | RASQRVSSS YLV | 49 | GASSRAT | 59 | QQYGS SPYT |
| Antibody 10 | 40 | RASQRVSSS YLV | 50 | GASSRAT | 60 | QQYGS SPYT |

TABLE 1.2 B

AMINO ACID SEQUENCES OF EXEMPLARY CDRS OF ANTIBODY 5-10
Chothia Numbering

| Antibody | CDRH1 SEQ ID NO | CDRH1 | CDRH2 SEQ ID NO | CDRH2 | CDRH3 SEQ ID NO | CDRH3 |
|---|---|---|---|---|---|---|
| Antibody 5 | 55 | GFTFSNV | 75 | KSKTDAGT | 85 | RGWGEN |
| Antibody 6 | 66 | GFIFSNV | 76 | KSKIDAGT | 86 | RGWGEN |
| Antibody 7 | 67 | GFTFSNA | 77 | KSKIDAGT | 87 | LGWGEN |
| Antibody 8 | 68 | GFTFSNA | 78 | KSKIDAGT | 88 | LGWGEN |
| Antibody 9 | 69 | GFTFSNA | 79 | KSKIDAGT | 89 | LGWGEN |
| Antibody 10 | 70 | GFTFSNA | 80 | KSKIDAGT | 90 | LGWGEN |

| Antibody | CDRL1 SEQ ID NO | CDRL1 | CDRL2 SEQ ID NO | CDRL2 | CDRL3 SEQ ID NO | CDRL3 |
|---|---|---|---|---|---|---|
| Antibody 5 | 95 | SQIFSSSY | | GAS | 115 | YGNSPY |
| Antibody 6 | 96 | SQSVSSSY | | GAS | 116 | YGGSPY |
| Antibody 7 | 97 | SQSISRSY | | GAS | 117 | YGSSPY |
| Antibody 8 | 98 | SQRVSSSY | | GAS | 118 | YGSSPY |
| Antibody 9 | 99 | SQRVSSSY | | GAS | 119 | YGSSPY |
| Antibody 10 | 100 | SQRVSSSY | | GAS | 120 | YGSSPY |

TABLE 1.3 B

AMINO ACID SEQUENCES OF EXEMPLARY CDRS OF ANTIBODY 5-10
IMGT Numbering

| Antibody | CDRH1 SEQ ID NO | CDRH1 | CDRH2 SEQ ID NO | CDRH2 | CDRH3 SEQ ID NO | CDRH3 |
|---|---|---|---|---|---|---|
| Antibody 5 | 125 | GFTFSNVW | 135 | IKSKTDAGTT | 145 | TTDRGWGENY |
| Antibody 6 | 126 | GFIFSNVW | 136 | IKSKIDAGTT | 146 | ITDRGWGENY |
| Antibody 7 | 127 | GFTFSNAW | 137 | IKSKIDAGTT | 147 | TTDLGWGENY |
| Antibody 8 | 128 | GFTFSNAW | 138 | IKSKIDAGTT | 148 | TTDLGWGENY |
| Antibody 9 | 129 | GFTFSNAW | 139 | IKSKIDAGTT | 149 | TTDLGWGENY |
| Antibody 10 | 130 | GFTFSNAW | 140 | IKSKIDAGTT | 150 | TTDLGWGENY |

TABLE 1.3 B-continued

AMINO ACID SEQUENCES OF EXEMPLARY CDRS OF ANTIBODY 5-10
IMGT Numbering

| Antibody | CDRL1 SEQ ID NO | CDRL1 | CDRL2 SEQ ID NO | CDRL2 | CDRL3 SEQ ID NO | CDRL3 |
|---|---|---|---|---|---|---|
| Antibody 5 | 155 | QIFSSSY | | GAS | 175 | QQYGNSPYT |
| Antibody 6 | 156 | QSVSSSY | | GAS | 176 | QQYGGSPYT |
| Antibody 7 | 157 | QSISRSY | | GAS | 177 | HQYGSSPYT |
| Antibody 8 | 158 | QRVSSSY | | GAS | 178 | QQYGSSPYT |
| Antibody 9 | 159 | QRVSSSY | | GAS | 179 | QQYGSSPYT |
| Antibody 10 | 160 | QRVSSSY | | GAS | 180 | QQYGSSPYT |

TABLE 1.1 C

AMINO ACID SEQUENCES OF EXEMPLARY CDRS OF ANTIBODY 11-119
Kabat Numbering (EU index)

| Name | CDRH1 SEQ ID NO | CDRH1 | CDRH2 SEQ ID NO | CDRH2 | CDRH3 SEQ ID NO | CDRH3 |
|---|---|---|---|---|---|---|
| Antibody 11 | 313 | GYYMH | 422 | WINPKSGGTIYAQKFQG | 531 | GGSFDAFDI |
| Antibody 12 | 314 | GYYWS | 423 | EITHSGITNYNPSLES | 532 | GQVGTTDYYYFYMDV |
| Antibody 13 | 315 | GYYMH | 424 | WINPNSGGTNYAQNFQG | 533 | GGSFDAFDI |
| Antibody 14 | 316 | GYYMH | 425 | WINPKSGGTNYAQNFQG | 534 | GGSFDAFDI |
| Antibody 15 | 317 | GYYMH | 426 | WINPNSGGTNYAQKFQG | 535 | GGSFDAFDI |
| Antibody 16 | 318 | AYYMH | 427 | WINPNSGGTNYAQSFQG | 536 | GGSFDAFDI |
| Antibody 17 | 319 | AYYMH | 428 | WINPKSGGTNYAQSFQG | 537 | GGSFDAFDI |
| Antibody 18 | 320 | AYYMH | 429 | WINPNSGGTNYAQQFQG | 538 | GGSYDAFDI |
| Antibody 19 | 321 | AYYMH | 430 | WINPKSGGTNYAQQFQG | 539 | GGSYDAFDI |
| Antibody 20 | 322 | AYYIH | 431 | WINPNSGGTNYAQKFQG | 540 | GGSFDAFDI |

TABLE 1.1 C-continued

AMINO ACID SEQUENCES OF EXEMPLARY CDRS OF ANTIBODY 11-119
Kabat Numbering (EU index)

| | | | | | | |
|---|---|---|---|---|---|---|
| Antibody 323 21 | AYYIH | 432 | WINPKSGGTNYAQKFQG | 541 | GGSFDAFDI | |
| Antibody 324 22 | GYYLH | 433 | WINPNSGGTNFAQKFQG | 542 | GGSYDAFDI | |
| Antibody 325 23 | GYYLH | 434 | WINPKSGGTNFAQKFQG | 543 | GGSYDAFDI | |
| Antibody 326 24 | GYYMH | 435 | WINPNSGGTNYAQKFQG | 544 | GGSYDAFDI | |
| Antibody 327 25 | GYYMH | 436 | WINPKSGGTNYAQKFQG | 545 | GGSYDAFDI | |
| Antibody 328 26 | GYYLH | 437 | WINPNSGGTNYAQRFQG | 546 | GGSFDAFDI | |
| Antibody 329 27 | GYYLH | 438 | WINPKSGGTNYAQRFQG | 547 | GGSFDAFDI | |
| Antibody 330 28 | GYYMH | 439 | WINPKSGGTIYAQKFQG | 548 | GGSFDAFDI | |
| Antibody 331 29 | GYYMH | 440 | WINPKSGGTNYAQKFQG | 549 | GGSFDAFDI | |
| Antibody 332 30 | GYYMH | 441 | WINPKSGGTSYAQKFQG | 550 | GGSYDAFDI | |
| Antibody 333 31 | GYYMH | 442 | WINPKSGGTNYAQKFQG | 551 | GGSYDAFDI | |
| Antibody 334 32 | AYYIH | 443 | WINPNSGGTNYAQNFQG | 552 | GGSFDAFDI | |
| Antibody 335 33 | AYYIH | 444 | WINPKSGGTNYAQNFQG | 553 | GGSFDAFDI | |
| Antibody 336 34 | GYYMH | 445 | WINPKSGGTNYAQNFQG | 554 | GGSFDAFDI | |
| Antibody 337 35 | GYYMH | 446 | WINPNSGGTNYAQKFQG | 555 | GGSYDAFDI | |
| Antibody 338 36 | GYYMH | 447 | WINPKSGGTNYAQKFQG | 556 | GGSYDAFDI | |
| Antibody 339 37 | AYYMH | 448 | WINPNSGGTKYAQKFQG | 557 | GGSYDAFDI | |
| Antibody 340 38 | AYYMH | 449 | WINPKSGGTKYAQKFQG | 558 | GGSYDAFDI | |
| Antibody 341 39 | AYYLH | 450 | WINPNSGGTNYAQKFQG | 559 | GGSFDAFDI | |
| Antibody 342 40 | AYYLH | 451 | WINPKSGGTNYAQKFQG | 560 | GGSFDAFDI | |
| Antibody 343 41 | GYFIH | 452 | WINPKSGGTNYAQKFQD | 561 | GGSYDAFDI | |
| Antibody 344 42 | AYYMH | 453 | WINPNSGGTKYAQKFQG | 562 | GGSYDAFDI | |
| Antibody 345 43 | AYYMH | 454 | WINPK SGGTKYAQKFQG | 563 | GGSYDAFDI | |
| Antibody 346 44 | AYYIH | 455 | WINPNSGGTSSAQKFQG | 564 | GGSFDAFDI | |
| Antibody 347 45 | AYYIH | 456 | WINPKSGGTSSAQKFQG | 565 | GGSFDAFDI | |
| Antibody 348 46 | AYYIH | 457 | WVNPNSGGTNYAQSFQG | 566 | GGSFDAFDI | |
| Antibody 349 47 | AYYIH | 458 | WVNPKSGGTNYAQSFQG | 567 | GGSFDAFDI | |
| Antibody 350 48 | AYYMH | 459 | WINPNSGGTKYAQKFQG | 568 | GGSFDAFDI | |
| Antibody 351 49 | AYYMH | 460 | WINPKSGGTKYAQKFQG | 569 | GGSFDAFDI | |
| Antibody 352 50 | GYYIH | 461 | WINPKSGGTNYAQKFQG | 570 | GGSYDAFDI | |
| Antibody 353 51 | GYYMH | 462 | WINPNSGGTNYAQKFQG | 571 | GGSYDAFDI | |
| Antibody 354 52 | GYYMH | 463 | WINPKSGGTNYAQKFQG | 572 | GGSYDAFDI | |
| Antibody 355 53 | GYYMH | 464 | WIHPNSGGTNSAQKFQG | 573 | GGSYDAFDI | |
| Antibody 356 54 | GYYMH | 465 | WIHPKSGGTNTAQKFQG | 574 | GGSYDAFDI | |
| Antibody 357 55 | GYFIH | 466 | WINPKSGGTNYAQKFQG | 575 | GGSFDAFDI | |
| Antibody 358 56 | GYYMH | 467 | WINPNSGGTNYAQKFQG | 576 | GGSFDAFDI | |
| Antibody 359 57 | GYYMH | 468 | WINPKSGGTNYAQKFQG | 577 | GGSFDAFDI | |
| Antibody 360 58 | GYYMH | 469 | WINPNSGGPNYAQKFQD | 578 | GGSFDAFDI | |

TABLE 1.1 C-continued

AMINO ACID SEQUENCES OF EXEMPLARY CDRS OF ANTIBODY 11-119
Kabat Numbering (EU index)

| | | | | | | |
|---|---|---|---|---|---|---|
| Antibody 59 | 361 | GYYMH | 470 | WINPKSGGPNYAQKFQD | 579 | GGSFDAFDI |
| Antibody 60 | 362 | GYFMH | 471 | WINPNSGGTNYAQRFQG | 580 | GGSFDAFDI |
| Antibody 61 | 363 | GYFMH | 472 | WINPKSGGTNYAQRFQG | 581 | GGSFDAFDI |
| Antibody 62 | 364 | GYYMH | 473 | WINPNSGGTNYAQKFQG | 582 | GGSFDAFDV |
| Antibody 63 | 365 | GYYMH | 474 | WINPKSGGTNYAQKFQG | 583 | GGSFDAFDV |
| Antibody 64 | 366 | GYYMQ | 475 | WINPNSGGTIYAQKFQG | 584 | GGSFDAFDI |
| Antibody 65 | 367 | GYYMQ | 476 | WINPKSGGTIYAQKFQG | 585 | GGSFDAFDI |
| Antibody 66 | 368 | GYYLH | 477 | WIKPNSGGTNYAQKFQG | 586 | GGSYDAFDI |
| Antibody 67 | 369 | GYYLH | 478 | WIKPKSGGTNYAQKFQG | 587 | GGSYDAFDI |
| Antibody 68 | 370 | AYYMH | 479 | WVNPNSGGTNYAQNFQG | 588 | GGSFDAFDI |
| Antibody 69 | 371 | AYYMH | 480 | WVNPKSGGTNYAQNFQG | 589 | GGSFDAFDI |
| Antibody 70 | 372 | GYYMH | 481 | WINPNSGGTNYAQKFQG | 590 | GGSFDAFDI |
| Antibody 71 | 373 | GYYMH | 482 | WINPKSGGTNYAQKFQG | 591 | GGSFDAFDI |
| Antibody 72 | 374 | GYYMH | 483 | WINPNSGGTNYAQRFQG | 592 | GGSFDAFDI |
| Antibody 73 | 375 | GYYMH | 484 | WINPKSGGTNYAQRFQG | 593 | GGSFDAFDI |
| Antibody 74 | 376 | GYYMH | 485 | WIKPNSGGTNYAQKFQG | 594 | GGSYDAFDI |
| Antibody 75 | 377 | GYYMH | 486 | WIKPKSGGTNYAQKFQG | 595 | GGSYDAFDI |
| Antibody 76 | 378 | GYYIH | 487 | WINPNSGGTNYAQKFQG | 596 | GGSFDAFDI |
| Antibody 77 | 379 | GYYIH | 488 | WINPKSGGTNYAQKFQG | 597 | GGSFDAFDI |

TABLE 1.1 C-continued

AMINO ACID SEQUENCES OF EXEMPLARY CDRS OF ANTIBODY 11-119
Kabat Numbering (EU index)

| | | | | | | |
|---|---|---|---|---|---|---|
| Antibody 78 | 380 | AYYMH | 489 | WINPNSGGTKYAQKFQG | 598 | GGSYDAFDI |
| Antibody 79 | 381 | AYYMH | 490 | WINPKSGGTKYAQKFQG | 599 | GGSYDAFDI |
| Antibody 80 | 382 | GYYMH | 491 | WINPNSGGTNYAQKFQG | 600 | GGSFDAFDI |
| Antibody 81 | 383 | GYYMH | 492 | WINPNSGGTNYAQKFQG | 601 | GGSYDAFDI |
| Antibody 82 | 384 | GYYMH | 493 | WINPKSGGTNYAQKFQG | 602 | GGSYDAFDI |
| Antibody 83 | 385 | GYYMH | 494 | WINPNSGATNFAQKFQG | 603 | GGSFDAFDI |
| Antibody 84 | 386 | GYYMH | 495 | WINPKSGATNFAQKFQG | 604 | GGSFDAFDI |
| Antibody 85 | 387 | AYYLH | 496 | WINPNSGGTNYAQKFQD | 605 | GGSYDAFDI |
| Antibody 86 | 388 | AYYLH | 497 | WINPKSGGTNYAQKFQD | 606 | GGSYDAFDI |
| Antibody 87 | 389 | AYYMH | 498 | WINPNSGGTKYAQKFQG | 607 | GGSYDAFDI |
| Antibody 88 | 390 | AYYMH | 499 | WINPKSGGTKYAQKFQG | 608 | GGSYDAFDI |
| Antibody 89 | 391 | GYYMH | 500 | WINPKSGGTNYAQKFQG | 609 | GGSYDAFDI |
| Antibody 90 | 392 | GYYMH | 501 | WINPKSGGTNYAQKFQG | 610 | GGSYDAFDI |
| Antibody 91 | 393 | AYYLH | 502 | WINPNSGGTSSAQKFQG | 611 | GGSFDAFDI |
| Antibody 92 | 394 | AYYLH | 503 | WINPKSGGTSSAQKFQG | 612 | GGSFDAFDI |
| Antibody 93 | 395 | GYYMH | 504 | WINPNSGGTHYAQKFQG | 613 | GGSFDAFDI |
| Antibody 94 | 396 | GYYMH | 505 | WINPKSGGTHYAQKFQG | 614 | GGSFDAFDI |
| Antibody 95 | 397 | GYYIH | 506 | WINPNSGGTNYAQRFQG | 615 | GGSFDAFDI |
| Antibody 96 | 398 | GYYMH | 507 | WINPKSGGTIYAQKFQG | 616 | GGSFDAFDI |

TABLE 1.1 C-continued

AMINO ACID SEQUENCES OF EXEMPLARY CDRS OF ANTIBODY 11-119
Kabat Numbering (EU index)

| | | | | | | |
|---|---|---|---|---|---|---|
| Antibody 97 | 399 | AYYIH | 508 | WINPNSGGTNYAQKFQG | 617 | GGSYDAFDI |
| Antibody 98 | 400 | GYFMH | 509 | WINPKSGGTNYAQKFQG | 618 | GGSFDAFDI |
| Antibody 99 | 401 | GYYMH | 510 | WINPNSGGTKYAQKFQG | 619 | GGSFDAFDI |
| Antibody 100 | 402 | GYYMH | 511 | WINPNSGGTNYAQKFQG | 620 | GGSFDAFDI |
| Antibody 101 | 403 | GYYMH | 512 | WINPNSGGTNYAQKFQG | 621 | GGSYDAFDI |
| Antibody 102 | 404 | GYYMH | 513 | WINPNSGGTKYSQKFQG | 622 | GGSFDAFDI |
| Antibody 103 | 405 | GYYMH | 514 | WINPNSGGTNYAQKFQG | 623 | GGSYDAFDI |
| Antibody 104 | 406 | AYYMH | 515 | WINPNSGGTNYAQKFQG | 624 | GGSIDAFDI |
| Antibody 105 | 407 | AYYIH | 516 | WINPNSGGTNYAQKFQD | 625 | GGSYDAFDI |
| Antibody 106 | 408 | GYYIH | 517 | WINPNSGGTKYAQKFHG | 626 | GGSFDAFDI |
| Antibody 107 | 409 | GYYMH | 518 | WINPNSGGTNYAQKFQG | 627 | GGSFDAFDV |
| Antibody 108 | 410 | GYYMH | 519 | WINPNSGGTNYAQKFQG | 628 | GGSFDAFDI |
| Antibody 109 | 411 | AYYIH | 520 | WINPNSGGTNYAQRFQG | 629 | GGSFDAFDI |
| Antibody 110 | 412 | GYYMH | 521 | WINPKSGGTNYAQKFQG | 630 | GGSFDAFDI |
| Antibody 111 | 413 | AYYIH | 522 | WINPNSGGTSSAQKFQG | 631 | GGSFDAFDI |
| Antibody 112 | 414 | GYYMH | 523 | WINPNSGGTNYAQKFQG | 632 | GGSYDAFDI |
| Antibody 113 | 415 | GYYMH | 524 | WINPNSGGTKYAQKFQG | 633 | GGSYDAFDI |
| Antibody 114 | 416 | GYYMH | 525 | WINPKSGGTNYAQKFQG | 634 | GGSFDAFDI |
| Antibody 115 | 417 | RYGMN | 526 | WINTNTGNPTYAQDFTG | 635 | DNWNYVSDY |
| Antibody 116 | 418 | GYYMH | 527 | WINPKSGGTIYAQKFQG | 636 | GGSFDAFDI |
| Antibody 117 | 419 | VYYMH | 528 | WINPNSGGTNYAQKFQG | 637 | GGSFDAFDI |
| Antibody 118 | 420 | RYGMN | 529 | WINTNTGNPTYAQGFTG | 638 | DNWNYDFDY |
| Antibody 119 | 421 | TYGMN | 530 | WINTNTGNPTYAQGFTG | 639 | DNWNYDLDY |

| Name | CDRL1 SEQ ID NO | CDRL1 | CDRL2 SEQ ID NO | CDRL2 | CDRL3 SEQ ID NO | CDRL3 |
|---|---|---|---|---|---|---|
| Antibody 11 | 640 | RASQSISRYLY | 749 | GASSLQS | 858 | QQGFSAPLT |
| Antibody 12 | 641 | RASQSIRRYLN | 750 | AASSLQS | 859 | QQSYRTIT |
| Antibody 13 | 642 | RASQSISRYLN | 751 | GASSVQS | 860 | QQGDSSPFT |
| Antibody 14 | 643 | RASQSISRYLN | 752 | GASSVQS | 861 | QQGDSSPFT |
| Antibody 15 | 644 | RASQSISSYLN | 753 | GASSLQS | 862 | QQGHSTPFT |
| Antibody 16 | 645 | RASQSISRYLN | 754 | GASSVQS | 863 | QQGDSSPFT |
| Antibody 17 | 646 | RASQSISRYLN | 755 | GASSVQS | 864 | QQGDSSPFT |
| Antibody 18 | 647 | RASQSISSYLN | 756 | GASRLQS | 865 | QQGHSTPFT |
| Antibody 19 | 648 | RASQSISSYLN | 757 | GASRLQS | 866 | QQGHSTPFT |
| Antibody 20 | 649 | RASQSISSYLN | 758 | GASSLQS | 867 | QQGDSTPFT |
| Antibody 21 | 650 | RASQSISSYLN | 759 | GASSLQS | 868 | QQGDSTPFT |
| Antibody 22 | 651 | RASQSISSYLN | 760 | GASRLQS | 869 | QQGDSTPFT |
| Antibody 23 | 652 | RASQSISSYLN | 761 | GASRLQS | 870 | QQGDSTPFT |
| Antibody 24 | 653 | RASQSISSYLN | 762 | GASRLQS | 871 | QQGDSTPFT |
| Antibody 25 | 654 | RASQSISSYLN | 763 | GASRLQS | 872 | QQGDSTPFT |
| Antibody 26 | 655 | RASQSISSYLN | 764 | GASRLQS | 873 | QQGDSSPFT |
| Antibody 27 | 656 | RASQSISSYLN | 765 | GASRLQS | 874 | QQGDSSPFT |
| Antibody 28 | 657 | RASQSISSYLN | 766 | GASSLQS | 875 | QQGHSTPFT |

TABLE 1.1 C-continued

AMINO ACID SEQUENCES OF EXEMPLARY CDRS OF ANTIBODY 11-119
Kabat Numbering (EU index)

| | | | | | | | |
|---|---|---|---|---|---|---|---|
| Antibody 29 | 658 | RASQSISSYLN | 767 | GASSLQS | 876 | QQGDSTPFT |
| Antibody 30 | 659 | RASQSISSYLN | 768 | GASSLQS | 877 | QQGHSTPFT |
| Antibody 31 | 660 | RASQSISSYLN | 769 | GASRLQS | 878 | QQGYSSPFT |
| Antibody 32 | 661 | QASQDISNYLN | 770 | GASSLQS | 879 | QQGDSTPFT |
| Antibody 33 | 662 | QASQDISNYLN | 771 | GASSLQS | 880 | QQGDSTPFT |
| Antibody 34 | 663 | RASQGISRYLH | 772 | GASSLQS | 881 | QQGFSTPFT |
| Antibody 35 | 664 | RASQSISSYLN | 773 | GASRLQS | 882 | QQGSSPPFT |
| Antibody 36 | 665 | RASQSISSYLN | 774 | GASRLQS | 883 | QQGSSPPFT |
| Antibody 37 | 666 | RASQSISSYLN | 775 | GASRLQS | 884 | QQGYSSPFT |
| Antibody 38 | 667 | RASQSISSYLN | 776 | GASRLQS | 885 | QQGYSSPFT |
| Antibody 39 | 668 | RASQSISRYLN | 777 | GASSVQS | 886 | QQGDSSPFT |
| Antibody 40 | 669 | RASQSISRYLN | 778 | GASSVQS | 887 | QQGDSSPFT |
| Antibody 41 | 670 | RASQSISSYLN | 779 | GASRLQS | 888 | QQGHSTPFT |
| Antibody 42 | 671 | RASQSISSYLN | 780 | GASRLQS | 889 | QQGDSTPFT |
| Antibody 43 | 672 | RASQSISSYLN | 781 | GASRLQS | 890 | QQGDSTPFT |
| Antibody 44 | 673 | RASQSISSYLN | 782 | GASRLQS | 891 | QQGYSSPFT |
| Antibody 45 | 674 | RASQSISSYLN | 783 | GASRLQS | 892 | QQGYSSPFT |
| Antibody 46 | 675 | RASQSISSYLN | 784 | GASSLQS | 893 | QQGHSTPFT |
| Antibody 47 | 676 | RASQSISSYLN | 785 | GASSLQS | 894 | QQGHSTPFT |
| Antibody 48 | 677 | RASQSISSYLN | 786 | GASSLQS | 895 | QQGDSTPFT |
| Antibody 49 | 678 | RASQSISSYLN | 787 | GASSLQS | 896 | QQGDSTPFT |
| Antibody 50 | 679 | RASQSISSYLN | 788 | GASSLQS | 897 | QQGDSTPFT |
| Antibody 51 | 680 | RASQSISSYLN | 789 | GASSLQS | 898 | QQGDSTPFT |
| Antibody 52 | 681 | RASQSISSYLN | 790 | GASSLQS | 899 | QQGDSTPFT |
| Antibody 53 | 682 | RASQSISSYLN | 791 | GASRLQS | 900 | QQGYSSPFT |
| Antibody 54 | 683 | RASQSISSYLN | 792 | GASRLQS | 901 | QQGYSSPFT |
| Antibody 55 | 684 | RASQSISRYLN | 793 | GASSVQS | 902 | QQGDSSPFT |
| Antibody 56 | 685 | RASQSISSYLN | 794 | GASRLQS | 903 | QQGYSSPFT |
| Antibody 57 | 686 | RASQSISSYLN | 795 | GASRLQS | 904 | QQGYSSPFT |
| Antibody 58 | 687 | RASQSISNYLN | 796 | GTSRLQS | 905 | QQGYSSPFT |
| Antibody 59 | 688 | RASQSISNYLN | 797 | GTSRLQS | 906 | QQGYSSPFT |
| Antibody 60 | 689 | RASQSISSYLN | 798 | GASRLQS | 907 | QQGYSSPFT |
| Antibody 61 | 690 | RASQSISSYLN | 799 | GASRLQS | 908 | QQGYSSPFT |
| Antibody 62 | 691 | RASQSISSYLN | 800 | GASRLQS | 909 | QQGDNTPFT |
| Antibody 63 | 692 | RASQSISSYLN | 801 | GASRLQS | 910 | QQGDNTPFT |
| Antibody 64 | 693 | RASQSISSYLN | 802 | GASRLQS | 911 | QQGHSTPFT |
| Antibody 65 | 694 | RASQSISSYLN | 803 | GASRLQS | 912 | QQGHSTPFT |
| Antibody 66 | 695 | RASQSISSYLN | 804 | GASRLQS | 913 | QQGYSSPFT |
| Antibody 67 | 696 | RASQSISSYLN | 805 | GASRLQS | 914 | QQGYSSPFT |
| Antibody 68 | 697 | RASQSISSYLN | 806 | GASSLQS | 915 | QQGHSTPFT |
| Antibody 69 | 698 | RASQSISSYLN | 807 | GASSLQS | 916 | QQGHSTPFT |
| Antibody 70 | 699 | RASQTISSYLN | 808 | GASSLQS | 917 | QQGDSTPFT |
| Antibody 71 | 700 | RASQTISSYLN | 809 | GASSLQS | 918 | QQGDSTPFT |
| Antibody 72 | 701 | RASQSISKYLI | 810 | GASSLQS | 919 | QQGHSTPFT |
| Antibody 73 | 702 | RASQSISKYLI | 811 | GASSLQS | 920 | QQGHSTPFT |
| Antibody 74 | 703 | RASQSISSYLN | 812 | GASRLQS | 921 | QQGDSTPFT |
| Antibody 75 | 704 | RASQSISSYLN | 813 | GASRLQS | 922 | QQGDSTPFT |
| Antibody 76 | 705 | RASQSISSYLN | 814 | GASRLQS | 923 | QQGYSSPFT |
| Antibody 77 | 706 | RASQSISSYLN | 815 | GASRLQS | 924 | QQGYSSPFT |
| Antibody 78 | 707 | RASLSISSYLN | 816 | GASSLQS | 925 | QQGHSTPFT |

TABLE 1.1 C-continued

AMINO ACID SEQUENCES OF EXEMPLARY CDRS OF ANTIBODY 11-119
Kabat Numbering (EU index)

| | | | | | | |
|---|---|---|---|---|---|---|
| Antibody 79 | 708 | RASLSISS YLN | 817 | GASSLQS | 926 | QQGHSTP FT |
| Antibody 80 | 709 | RASQSISS YLN | 818 | GASSLQS | 927 | QQGDSTP FT |
| Antibody 81 | 710 | RSSQSISS YLN | 819 | GASSLQS | 928 | QQGDSTP FT |
| Antibody 82 | 711 | RSSQSISS YLN | 820 | GASSLQS | 929 | QQGDSTP FT |
| Antibody 83 | 712 | RASRSISS YLN | 821 | GASRLQT | 930 | QQGYSSP FT |
| Antibody 84 | 713 | RASRSISS YLN | 822 | GASRLQT | 931 | QQGYSSP FT |
| Antibody 85 | 714 | RASQSIN SYLN | 823 | GASSLQS | 932 | QQGYSTP FT |
| Antibody 86 | 715 | RASQSIQ SYLN | 824 | GASSLQS | 933 | QQGYSTP FT |
| Antibody 87 | 716 | RASQSISS YLN | 825 | GASRLQS | 934 | QQGDNT PFT |
| Antibody 88 | 717 | RASQSISS YLN | 826 | GASRLQS | 935 | QQGDNT PFT |
| Antibody 89 | 718 | RASQSIN SYLY | 827 | GASSLQS | 936 | QQGYSTP FT |
| Antibody 90 | 719 | RASQSIQ SYLY | 828 | GASSLQS | 937 | QQGYSTP FT |
| Antibody 91 | 720 | RASQSISS YLN | 829 | GASSLQS | 938 | QQGDSTP FT |
| Antibody 92 | 721 | RASQSISS YLN | 830 | GASSLQS | 939 | QQGDSTP FT |
| Antibody 93 | 722 | RASLSISS YLN | 831 | GASSLQS | 940 | QQGHSTP FT |
| Antibody 94 | 723 | RASLSISS YLN | 832 | GASSLQS | 941 | QQGHSTP FT |
| Antibody 95 | 724 | RASQSISS YLN | 833 | GASRLQS | 942 | QQGYSSP FT |
| Antibody 96 | 725 | RASQTIS RYLN | 834 | GASSLQS | 943 | QQSYSTP FT |
| Antibody 97 | 726 | RASQTIS RYLN | 835 | GASSLQS | 944 | QQGYSTP FT |
| Antibody 98 | 727 | RASQSISS YLN | 836 | GASRLQS | 945 | QQGDSTP FT |
| Antibody 99 | 728 | RASQSISS YLN | 837 | GASRLQS | 946 | QQGYSSP FT |
| Antibody 100 | 729 | RASQSIS RYLN | 838 | GASSVQS | 947 | QQGDSSP FT |
| Antibody 101 | 730 | RASQSIS RYLN | 839 | GASSLQS | 948 | QQGYSTL FT |
| Antibody 102 | 731 | RASQSISS YLN | 840 | GASRLQS | 949 | QQGYSSP FT |
| Antibody 103 | 732 | RASQSISS YLN | 841 | GASRLQS | 950 | QQGYSN PFT |
| Antibody 104 | 733 | RASQSISS YLN | 842 | GASRLQS | 951 | QQGFSTP FT |
| Antibody 105 | 734 | RASQSISS YLN | 843 | GASRLQS | 952 | QQGYSSP FT |
| Antibody 106 | 735 | RASQSIS RYLN | 844 | GASRLQS | 953 | QQGYSSP FT |
| Antibody 107 | 736 | RASQSISS YLN | 845 | GASSLQS | 954 | QQGDSTP FT |
| Antibody 108 | 737 | RASQSISS FLN | 846 | GASRLQS | 955 | QQGDSTP FT |
| Antibody 109 | 738 | RASQSISS YLN | 847 | GASSLQS | 956 | QQGHSTP FT |
| Antibody 110 | 739 | RASQSISS YLN | 848 | GASSLQS | 957 | QQGHSTP FT |
| Antibody 111 | 740 | RASQSISS YLN | 849 | GASRLQS | 958 | QQGHSTP IT |
| Antibody 112 | 741 | RASQSISS YLN | 850 | GASRLQS | 959 | QQGYSSP FT |
| Antibody 113 | 742 | RASQSIS RYLY | 851 | AASSLQS | 960 | QQGYDT PFT |
| Antibody 114 | 743 | QASQDIS NYLN | 852 | AASSLQT | 961 | QQGDSTP FT |
| Antibody 115 | 744 | RASQSVS DSYLA | 853 | GASSRAT | 962 | QQYGTSP IT |
| Antibody 116 | 745 | RASQSISS YLN | 854 | GASSLQS | 963 | QQAKSFP LT |
| Antibody 117 | 746 | RASQSISS YLN | 855 | GASRLQS | 964 | QQGYSSP FT |
| Antibody 118 | 747 | KSSQSLV HSDGNT YLS | 856 | KISNRFS | 965 | MQVTQF PIT |
| Antibody 119 | 748 | RSSQSLV HSDGNT YLS | 857 | KISNRFS | 966 | MQATQF PIT |

TABLE 1.2 C

AMINO ACID SEQUENCES OF EXEMPLARY CDRS OF ANTIBODY 11-119
Chothia Numbering

| Name | CDRH1 SEQ ID NO | CDRH1 | CDRH2 SEQ ID NO | CDRH2 | CDRH3 SEQ ID NO | CDRH3 |
|---|---|---|---|---|---|---|
| Antibody 11 | 967 | GYTFTGY | 1076 | NPKSGG | 1185 | GSFDAFD |
| Antibody 12 | 968 | GGSFSGY | 1077 | THSGI | 1186 | QVGTTD YYYFYM D |
| Antibody 13 | 969 | GYTFTGY | 1078 | NPNSGG | 1187 | GSFDAFD |
| Antibody 14 | 970 | GYTFTGY | 1079 | NPKSGG | 1188 | GSFDAFD |

TABLE 1.2 C-continued

AMINO ACID SEQUENCES OF EXEMPLARY CDRS OF ANTIBODY 11-119
Chothia Numbering

| | | | | | | |
|---|---|---|---|---|---|---|
| Antibody 15 | 971 | GYTFTGY | 1080 | NPNSGG | 1189 | GSFDAFD |
| Antibody 16 | 972 | GYTFTAY | 1081 | NPNSGG | 1190 | GSFDAFD |
| Antibody 17 | 973 | GYTFTAY | 1082 | NPKSGG | 1191 | GSFDAFD |
| Antibody 18 | 974 | GYTFTAY | 1083 | NPNSGG | 1192 | GSYDAF D |
| Antibody 19 | 975 | GYTFTAY | 1084 | NPKSGG | 1193 | GSYDAF D |
| Antibody 20 | 976 | GYTFTAY | 1085 | NPNSGG | 1194 | GSFDAFD |
| Antibody 21 | 977 | GYTFTAY | 1086 | NPKSGG | 1195 | GSFDAFD |
| Antibody 22 | 978 | GYTFTGY | 1087 | NPNSGG | 1196 | GSYDAF D |
| Antibody 23 | 979 | GYTFTGY | 1088 | NPKSGG | 1197 | GSYDAF D |
| Antibody 24 | 980 | GYTFTGY | 1089 | NPNSGG | 1198 | GSYDAF D |
| Antibody 25 | 981 | GYTFTGY | 1090 | NPKSGG | 1199 | GSYDAF D |
| Antibody 26 | 982 | GYTFTGY | 1091 | NPNSGG | 1200 | GSFDAFD |
| Antibody 27 | 983 | GYTFTGY | 1092 | NPKSGG | 1201 | GSFDAFD |
| Antibody 28 | 984 | GYTFTGY | 1093 | NPKSGG | 1202 | GSFDAFD |
| Antibody 29 | 985 | GYTFTGY | 1094 | NPKSGG | 1203 | GSFDAFD |
| Antibody 30 | 986 | GYTFTGY | 1095 | NPKSGG | 1204 | GSYDAF D |
| Antibody 31 | 987 | GYTFTGY | 1096 | NPKSGG | 1205 | GSYDAF D |
| Antibody 32 | 988 | GYTFTAY | 1097 | NPNSGG | 1206 | GSFDAFD |
| Antibody 33 | 989 | GYTFTAY | 1098 | NPKSGG | 1207 | GSFDAFD |
| Antibody 34 | 990 | GYTFTGY | 1099 | NPKSGG | 1208 | GSFDAFD |
| Antibody 35 | 991 | GYTFTGY | 1100 | NPNSGG | 1209 | GSYDAF D |
| Antibody 36 | 992 | GYTFTGY | 1101 | NPKSGG | 1210 | GSYDAF D |
| Antibody 37 | 993 | GYTFTAY | 1102 | NPNSGG | 1211 | GSYDAF D |
| Antibody 38 | 994 | GYTFTAY | 1103 | NPKSGG | 1212 | GSYDAF D |
| Antibody 39 | 995 | GYTFTAY | 1104 | NPNSGG | 1213 | GSFDAFD |
| Antibody 40 | 996 | GYTFTAY | 1105 | NPKSGG | 1214 | GSFDAFD |
| Antibody 41 | 997 | GYTFTGY | 1106 | NPKSGG | 1215 | GSYDAF D |
| Antibody 42 | 998 | GYTFTAY | 1107 | NPNSGG | 1216 | GSYDAF D |
| Antibody 43 | 999 | GYTFTAY | 1108 | NPKSGG | 1217 | GSYDAF D |
| Antibody 44 | 1000 | GYTFTAY | 1109 | NPNSGG | 1218 | GSFDAFD |
| Antibody 45 | 1001 | GYTFTAY | 1110 | NPKSGG | 1219 | GSFDAFD |
| Antibody 46 | 1002 | GYTFTAY | 1111 | NPNSGG | 1220 | GSFDAFD |
| Antibody 47 | 1003 | GYTFTAY | 1112 | NPKSGG | 1221 | GSFDAFD |
| Antibody 48 | 1004 | GYTFTAY | 1113 | NPNSGG | 1222 | GSFDAFD |
| Antibody 49 | 1005 | GYTFTAY | 1114 | NPKSGG | 1223 | GSFDAFD |
| Antibody 50 | 1006 | GYTFTGY | 1115 | NPKSGG | 1224 | GSYDAF D |
| Antibody 51 | 1007 | GYTFTGY | 1116 | NPNSGG | 1225 | GSYDAF D |
| Antibody 52 | 1008 | GYTFTGY | 1117 | NPKSGG | 1226 | GSYDAF D |
| Antibody 53 | 1009 | GYTFTGY | 1118 | HPNSGG | 1227 | GSYDAF D |
| Antibody 54 | 1010 | GYTFTGY | 1119 | HPKSGG | 1228 | GSYDAF D |
| Antibody 55 | 1011 | GYTFTGY | 1120 | NPKSGG | 1229 | GSFDAFD |
| Antibody 56 | 1012 | GYTFTGY | 1121 | NPNSGG | 1230 | GSFDAFD |
| Antibody 57 | 1013 | GYTFTGY | 1122 | NPKSGG | 1231 | GSFDAFD |
| Antibody 58 | 1014 | GYTFTGY | 1123 | NPNSGG | 1232 | GSFDAFD |
| Antibody 59 | 1015 | GYTFTGY | 1124 | NPKSGG | 1233 | GSFDAFD |
| Antibody 60 | 1016 | GYTFTGY | 1125 | NPNSGG | 1234 | GSFDAFD |
| Antibody 61 | 1017 | GYTFTGY | 1126 | NPKSGG | 1235 | GSFDAFD |
| Antibody 62 | 1018 | GYTFTGY | 1127 | NPNSGG | 1236 | GSFDAFD |
| Antibody 63 | 1019 | GYTFTGY | 1128 | NPKSGG | 1237 | GSFDAFD |
| Antibody 64 | 1020 | GYTFTGY | 1129 | NPNSGG | 1238 | GSFDAFD |

TABLE 1.2 C-continued

AMINO ACID SEQUENCES OF EXEMPLARY CDRS OF ANTIBODY 11-119 Chothia Numbering

| | | | | | | |
|---|---|---|---|---|---|---|
| Antibody 65 | 1021 | GYTFTGY | 1130 | NPKSGG | 1239 | GSFDAFD |
| Antibody 66 | 1022 | GYTFTGY | 1131 | KPNSGG | 1240 | GSYDAFD |
| Antibody 67 | 1023 | GYTFTGY | 1132 | KPKSGG | 1241 | GSYDAFD |
| Antibody 68 | 1024 | GYTFTAY | 1133 | NPNSGG | 1242 | GSFDAFD |
| Antibody 69 | 1025 | GYTFTAY | 1134 | NPKSGG | 1243 | GSFDAFD |
| Antibody 70 | 1026 | GYTFTGY | 1135 | NPNSGG | 1244 | GSFDAFD |
| Antibody 71 | 1027 | GYTFTGY | 1136 | NPKSGG | 1245 | GSFDAFD |
| Antibody 72 | 1028 | GYTFTGY | 1137 | NPNSGG | 1246 | GSFDAFD |
| Antibody 73 | 1029 | GYTFTGY | 1138 | NPKSGG | 1247 | GSFDAFD |
| Antibody 74 | 1030 | GYTFTGY | 1139 | KPNSGG | 1248 | GSYDAFD |
| Antibody 75 | 1031 | GYTFTGY | 1140 | KPKSGG | 1249 | GSYDAFD |
| Antibody 76 | 1032 | GYTFTGY | 1141 | NPNSGG | 1250 | GSFDAFD |
| Antibody 77 | 1033 | GYTFTGY | 1142 | NPKSGG | 1251 | GSFDAFD |
| Antibody 78 | 1034 | GYTFTAY | 1143 | NPNSGG | 1252 | GSYDAFD |
| Antibody 79 | 1035 | GYTFTAY | 1144 | NPKSGG | 1253 | GSYDAFD |
| Antibody 80 | 1036 | GYTFTGY | 1145 | NPNSGG | 1254 | GSFDAFD |
| Antibody 81 | 1037 | GYTFTGY | 1146 | NPNSGG | 1255 | GSYDAFD |
| Antibody 82 | 1038 | GYTFTGY | 1147 | NPKSGG | 1256 | GSYDAFD |
| Antibody 83 | 1039 | GYTFTGY | 1148 | NPNSGA | 1257 | GSFDAFD |
| Antibody 84 | 1040 | GYTFTGY | 1149 | NPKSGA | 1258 | GSFDAFD |
| Antibody 85 | 1041 | GYTFTAY | 1150 | NPNSGG | 1259 | GSYDAFD |
| Antibody 86 | 1042 | GYTFTAY | 1151 | NPKSGG | 1260 | GSYDAFD |
| Antibody 87 | 1043 | GYTFTAY | 1152 | NPNSGG | 1261 | GSYDAFD |
| Antibody 88 | 1044 | GYTFTAY | 1153 | NPKSGG | 1262 | GSYDAFD |
| Antibody 89 | 1045 | GYTFTGY | 1154 | NPKSGG | 1263 | GSYDAFD |
| Antibody 90 | 1046 | GYTFTGY | 1155 | NPKSGG | 1264 | GSYDAFD |
| Antibody 91 | 1047 | GYTFTAY | 1156 | NPNSGG | 1265 | GSFDAFD |
| Antibody 92 | 1048 | GYTFTAY | 1157 | NPKSGG | 1266 | GSFDAFD |
| Antibody 93 | 1049 | GYTFTGY | 1158 | NPNSGG | 1267 | GSFDAFD |
| Antibody 94 | 1050 | GYTFTGY | 1159 | NPKSGG | 1268 | GSFDAFD |
| Antibody 95 | 1051 | GYTFTGY | 1160 | NPNSGG | 1269 | GSFDAFD |
| Antibody 96 | 1052 | GYTFTGY | 1161 | NPKSGG | 1270 | GSFDAFD |
| Antibody 97 | 1053 | GYTFTAY | 1162 | NPNSGG | 1271 | GSYDAFD |
| Antibody 98 | 1054 | GYTFTGY | 1163 | NPKSGG | 1272 | GSFDAFD |
| Antibody 99 | 1055 | GYTFTGY | 1164 | NPNSGG | 1273 | GSFDAFD |
| Antibody 100 | 1056 | GYTFTGY | 1165 | NPNSGG | 1274 | GSFDAFD |
| Antibody 101 | 1057 | GYTFTGY | 1166 | NPNSGG | 1275 | GSYDAFD |
| Antibody 102 | 1058 | GYTFNGY | 1167 | NPNSGG | 1276 | GSFDAFD |
| Antibody 103 | 1059 | GYTFTGY | 1168 | NPNSGG | 1277 | GSYDAFD |
| Antibody 104 | 1060 | GYTFTAY | 1169 | NPNSGG | 1278 | GSIDAFD |
| Antibody 105 | 1061 | GYTFTAY | 1170 | NPNSGG | 1279 | GSYDAFD |
| Antibody 106 | 1062 | GYTFTGY | 1171 | NPNSGG | 1280 | GSFDAFD |
| Antibody 107 | 1063 | GYTFTGY | 1172 | NPNSGG | 1281 | GSFDAFD |
| Antibody 108 | 1064 | GYTFTGY | 1173 | NPNSGG | 1282 | GSFDAFD |
| Antibody 109 | 1065 | GYTFTAY | 1174 | NPNSGG | 1283 | GSFDAFD |
| Antibody 110 | 1066 | GYTFTGY | 1175 | NPKSGG | 1284 | GSFDAFD |
| Antibody 111 | 1067 | GYTFTAY | 1176 | NPNSGG | 1285 | GSFDAFD |
| Antibody 112 | 1068 | GYTFTGY | 1177 | NPNSGG | 1286 | GSYDAFD |
| Antibody 113 | 1069 | GYTFTGY | 1178 | NPNSGG | 1287 | GSYDAFD |
| Antibody 114 | 1070 | GYTFTGY | 1179 | NPKSGG | 1288 | GSFDAFD |

TABLE 1.2 C-continued

AMINO ACID SEQUENCES OF EXEMPLARY CDRS OF ANTIBODY 11-119
Chothia Numbering

| | | | | | | |
|---|---|---|---|---|---|---|
| Antibody 115 | 1071 | GYTFTRY | 1180 | NTNTGN | 1289 | NWNYVSD |
| Antibody 116 | 1072 | GYTFTGY | 1181 | NPKSGG | 1290 | GSFDAFD |
| Antibody 117 | 1073 | GYTFTVY | 1182 | NPNSGG | 1291 | GSFDAFD |
| Antibody 118 | 1074 | GYTFTRY | 1183 | NTNTGN | 1292 | NWNYDFD |
| Antibody 119 | 1075 | GYTFTTY | 1184 | NTNTGN | 1293 | NWNYDLD |

| Name | CDRL1 SEQ ID NO | CDRL1 | CDRL2 SEQ ID NO | CDRL2 | CDRL3 SEQ ID NO | CDRL3 |
|---|---|---|---|---|---|---|
| Antibody 11 | 1294 | SQSISRY | | GAS | 1512 | GFSAPL |
| Antibody 12 | 1295 | SQSIRRY | | AAS | 1513 | SYRTI |
| Antibody 13 | 1296 | SQSISRY | | GAS | 1514 | GDSSPF |
| Antibody 14 | 1297 | SQSISRY | | GAS | 1515 | GDSSPF |
| Antibody 15 | 1298 | SQSISSY | | GAS | 1516 | GHSTPF |
| Antibody 16 | 1299 | SQSISRY | | GAS | 1517 | GDSSPF |
| Antibody 17 | 1300 | SQSISRY | | GAS | 1518 | GDSSPF |
| Antibody 18 | 1301 | SQSISSY | | GAS | 1519 | GHSTPF |
| Antibody 19 | 1302 | SQSISSY | | GAS | 1520 | GHSTPF |
| Antibody 20 | 1303 | SQSISSY | | GAS | 1521 | GDSTPF |
| Antibody 21 | 1304 | SQSISSY | | GAS | 1522 | GDSTPF |
| Antibody 22 | 1305 | SQSISSY | | GAS | 1523 | GDSTPF |
| Antibody 23 | 1306 | SQSISSY | | GAS | 1524 | GDSTPF |
| Antibody 24 | 1307 | SQSISSY | | GAS | 1525 | GDSTPF |
| Antibody 25 | 1308 | SQSISSY | | GAS | 1526 | GDSTPF |
| Antibody 26 | 1309 | SQSISSY | | GAS | 1527 | GDSSPF |
| Antibody 27 | 1310 | SQSISSY | | GAS | 1528 | GDSSPF |
| Antibody 28 | 1311 | SQSISSY | | GAS | 1529 | GHSTPF |
| Antibody 29 | 1312 | SQSISSY | | GAS | 1530 | GDSTPF |

TABLE 1.2 C-continued

AMINO ACID SEQUENCES OF EXEMPLARY CDRS OF ANTIBODY 11-119
Chothia Numbering

| | | | | | | |
|---|---|---|---|---|---|---|
| Antibody 30 | 1313 | SQSISSY | | GAS | 1531 | GHSTPF |
| Antibody 31 | 1314 | SQSISSY | | GAS | 1532 | GYSSPF |
| Antibody 32 | 1315 | SQDISNY | | GAS | 1533 | GDSTPF |
| Antibody 33 | 1316 | SQDISNY | | GAS | 1534 | GDSTPF |
| Antibody 34 | 1317 | SQGISRY | | GAS | 1535 | GFSTPF |
| Antibody 35 | 1318 | SQSISSY | | GAS | 1536 | GSSPPF |
| Antibody 36 | 1319 | SQSISSY | | GAS | 1537 | GSSPPF |
| Antibody 37 | 1320 | SQSISSY | | GAS | 1538 | GYSSPF |
| Antibody 38 | 1321 | SQSISSY | | GAS | 1539 | GYSSPF |
| Antibody 39 | 1322 | SQSISRY | | GAS | 1540 | GDSSPF |
| Antibody 40 | 1323 | SQSISRY | | GAS | 1541 | GDSSPF |
| Antibody 41 | 1324 | SQSISSY | | GAS | 1542 | GHSTPF |
| Antibody 42 | 1325 | SQSISSY | | GAS | 1543 | GDSTPF |
| Antibody 43 | 1326 | SQSISSY | | GAS | 1544 | GDSTPF |
| Antibody 44 | 1327 | SQSISSY | | GAS | 1545 | GYSSPF |
| Antibody 45 | 1328 | SQSISSY | | GAS | 1546 | GYSSPF |
| Antibody 46 | 1329 | SQSISSY | | GAS | 1547 | GHSTPF |
| Antibody 47 | 1330 | SQSISSY | | GAS | 1548 | GHSTPF |
| Antibody 48 | 1331 | SQSISSY | | GAS | 1549 | GDSTPF |
| Antibody 49 | 1332 | SQSISSY | | GAS | 1550 | GDSTPF |
| Antibody 50 | 1333 | SQSISSY | | GAS | 1551 | GDSTPF |
| Antibody 51 | 1334 | SQSISSY | | GAS | 1552 | GDSTPF |
| Antibody 52 | 1335 | SQSISSY | | GAS | 1553 | GDSTPF |
| Antibody 53 | 1336 | SQSISSY | | GAS | 1554 | GYSSPF |
| Antibody 54 | 1337 | SQSISSY | | GAS | 1555 | GYSSPF |

TABLE 1.2 C-continued

AMINO ACID SEQUENCES OF EXEMPLARY CDRS OF ANTIBODY 11-119 Chothia Numbering

| | | | | | |
|---|---|---|---|---|---|
| Antibody 55 | 1338 | SQSISRY | GAS | 1556 | GDSSPF |
| Antibody 56 | 1339 | SQSISSY | GAS | 1557 | GYSSPF |
| Antibody 57 | 1340 | SQSISSY | GAS | 1558 | GYSSPF |
| Antibody 58 | 1341 | SQSISNY | GTS | 1559 | GYSSPF |
| Antibody 59 | 1342 | SQSISNY | GTS | 1560 | GYSSPF |
| Antibody 60 | 1343 | SQSISSY | GAS | 1561 | GYSSPF |
| Antibody 61 | 1344 | SQSISSY | GAS | 1562 | GYSSPF |
| Antibody 62 | 1345 | SQSISSY | GAS | 1563 | GDNTPF |
| Antibody 63 | 1346 | SQSISSY | GAS | 1564 | GDNTPF |
| Antibody 64 | 1347 | SQSISSY | GAS | 1565 | GHSTPF |
| Antibody 65 | 1348 | SQSISSY | GAS | 1566 | GHSTPF |
| Antibody 66 | 1349 | SQSISSY | GAS | 1567 | GYSSPF |
| Antibody 67 | 1350 | SQSISSY | GAS | 1568 | GYSSPF |
| Antibody 68 | 1351 | SQSISSY | GAS | 1569 | GHSTPF |
| Antibody 69 | 1352 | SQSISSY | GAS | 1570 | GHSTPF |
| Antibody 70 | 1353 | SQTISSY | GAS | 1571 | GDSTPF |
| Antibody 71 | 1354 | SQTISSY | GAS | 1572 | GDSTPF |
| Antibody 72 | 1355 | SQSISKY | GAS | 1573 | GHSTPF |
| Antibody 73 | 1356 | SQSISKY | GAS | 1574 | GHSTPF |
| Antibody 74 | 1357 | SQSISSY | GAS | 1575 | GDSTPF |
| Antibody 75 | 1358 | SQSISSY | GAS | 1576 | GDSTPF |
| Antibody 76 | 1359 | SQSISSY | GAS | 1577 | GYSSPF |
| Antibody 77 | 1360 | SQSISSY | GAS | 1578 | GYSSPF |
| Antibody 78 | 1361 | SLSISSY | GAS | 1579 | GHSTPF |
| Antibody 79 | 1362 | SLSISSY | GAS | 1580 | GHSTPF |

TABLE 1.2 C-continued

AMINO ACID SEQUENCES OF EXEMPLARY CDRS OF ANTIBODY 11-119 Chothia Numbering

| | | | | | |
|---|---|---|---|---|---|
| Antibody 80 | 1363 | SQSISSY | GAS | 1581 | GDSTPF |
| Antibody 81 | 1364 | SQSISSY | GAS | 1582 | GDSTPF |
| Antibody 82 | 1365 | SQSISSY | GAS | 1583 | GDSTPF |
| Antibody 83 | 1366 | SRSISSY | GAS | 1584 | GYSSPF |
| Antibody 84 | 1367 | SRSISSY | GAS | 1585 | GYSSPF |
| Antibody 85 | 1368 | SQSINSY | GAS | 1586 | GYSTPF |
| Antibody 86 | 1369 | SQSIQSY | GAS | 1587 | GYSTPF |
| Antibody 87 | 1370 | SQSISSY | GAS | 1588 | GDNTPF |
| Antibody 88 | 1371 | SQSISSY | GAS | 1589 | GDNTPF |
| Antibody 89 | 1372 | SQSINSY | GAS | 1590 | GYSTPF |
| Antibody 90 | 1373 | SQSIQSY | GAS | 1591 | GYSTPF |
| Antibody 91 | 1374 | SQSISSY | GAS | 1592 | GDSTPF |
| Antibody 92 | 1375 | SQSISSY | GAS | 1593 | GDSTPF |
| Antibody 93 | 1376 | SLSISSY | GAS | 1594 | GHSTPF |
| Antibody 94 | 1377 | SLSISSY | GAS | 1595 | GHSTPF |
| Antibody 95 | 1378 | SQSISSY | GAS | 1596 | GYSSPF |
| Antibody 96 | 1379 | SQTISRY | GAS | 1597 | SYSTPF |
| Antibody 97 | 1380 | SQTISRY | GAS | 1598 | GYSTPF |
| Antibody 98 | 138 | SQSISSY | GAS | 1599 | GDSTPF |
| Antibody 99 | 1382 | SQSISSY | GAS | 1600 | GYSSPF |
| Antibody 100 | 1383 | SQSISRY | GAS | 1601 | GDSSPF |
| Antibody 101 | 1384 | SQSISRY | GAS | 1602 | GYSTLF |
| Antibody 102 | 1385 | SQSISSY | GAS | 1603 | GYSSPF |
| Antibody 103 | 1386 | SQSISSY | GAS | 1604 | GYSNPF |
| Antibody 104 | 1387 | SQSISSY | GAS | 1605 | GFSTPF |

TABLE 1.2 C-continued

AMINO ACID SEQUENCES OF EXEMPLARY CDRS OF ANTIBODY 11-119
Chothia Numbering

| | | | | | |
|---|---|---|---|---|---|
| Antibody 105 | 1388 | SQSISSY | GAS | 1606 | GYSSPF |
| Antibody 106 | 1389 | SQSISRY | GAS | 1607 | GYSSPF |
| Antibody 107 | 1390 | SQSISSY | GAS | 1608 | GDSTPF |
| Antibody 108 | 1391 | SQSISSF | GAS | 1609 | GDSTPF |
| Antibody 109 | 1392 | SQSISSY | GAS | 1610 | GHSTPF |
| Antibody 110 | 1393 | SQSISSY | GAS | 1611 | GHSTPF |
| Antibody 111 | 1394 | SQSISSY | GAS | 1612 | GHSTPI |
| Antibody 112 | 1395 | SQSISSY | GAS | 1613 | GYSSPF |
| Antibody 113 | 1396 | SQSISRY | AAS | 1614 | GYDTPF |
| Antibody 114 | 1397 | SQDISNY | AAS | 1615 | GDSTPF |
| Antibody 115 | 1398 | SQSVSDS Y | GAS | 1616 | YGTSPI |
| Antibody 116 | 1399 | SQSISSY | GAS | 1617 | AKSFPL |
| Antibody 117 | 1400 | SQSISSY | GAS | 1618 | GYSSPF |
| Antibody 118 | 1401 | SQSL VHS DGNTY | KIS | 1619 | VTQFPI |
| Antibody 119 | 1402 | SQSLVHS DGNTY | KIS | 1620 | ATQFPI |

TABLE 1.3 C

AMINO ACID SEQUENCES OF EXEMPLARY CDRS OF ANTIBODY 11-119
IMGT Numbering

| Name | CDRH1 SEQ ID NO | CDRH1 | CDRH2 SEQ ID NO | CDRH2 | CDRH3 SEQ ID NO | CDRH3 |
|---|---|---|---|---|---|---|
| Antibody 11 | 1621 | GYTFTGY Y | 1730 | INPKSGG T | 1839 | ATGGSFD AFDI |
| Antibody 12 | 1622 | GGSFSGY Y | 1731 | ITHSGIT | 1840 | ARGQVG TTDYYYF YMDV |
| Antibody 13 | 1623 | GYTFTGY Y | 1732 | INPNSGG T | 1841 | AVGGSF DAFDI |
| Antibody 14 | 1624 | GYTFTGY Y | 1733 | INPKSGG T | 1842 | AVGGSF DAFDI |
| Antibody 15 | 1625 | GYTFTGY Y | 1734 | INPNSGG T | 1843 | AVGGSF DAFDI |
| Antibody 16 | 1626 | GYTFTAY Y | 1735 | INPNSGG T | 1844 | ATGGSFD AFDI |
| Antibody 17 | 1627 | GYTFTAY Y | 1736 | INPKSGG T | 1845 | ATGGSFD AFDI |
| Antibody 18 | 1628 | GYTFTAY Y | 1737 | INPNSGG T | 1846 | AVGGSY DAFDI |
| Antibody 19 | 1629 | GYTFTAY Y | 1738 | INPKSGG T | 1847 | AVGGSY DAFDI |
| Antibody 20 | 1630 | GYTFTAY Y | 1739 | INPNSGG T | 1848 | AVGGSF DAFDI |
| Antibody 21 | 1631 | GYTFTAY Y | 1740 | INPKSGG T | 1849 | AVGGSF DAFDI |
| Antibody 22 | 1632 | GYTFTGY Y | 1741 | INPNSGG T | 1850 | AVGGSY DAFDI |
| Antibody 23 | 1633 | GYTFTGY Y | 1742 | INPKSGG T | 1851 | AVGGSY DAFDI |

TABLE 1.3 C-continued

AMINO ACID SEQUENCES OF EXEMPLARY CDRS OF ANTIBODY 11-119
IMGT Numbering

| Name | CDRH1 SEQ ID NO | CDRH1 | CDRH2 SEQ ID NO | CDRH2 | CDRH3 SEQ ID NO | CDRH3 |
|---|---|---|---|---|---|---|
| Antibody 24 | 1634 | GYTFTGYY | 1743 | INPNSGGT | 1852 | AVGGSYDAFDI |
| Antibody 25 | 1635 | GYTFTGYY | 1744 | INPKSGGT | 1853 | AVGGSYDAFDI |
| Antibody 26 | 1636 | GYTFTGYY | 1745 | INPNSGGT | 1854 | ATGGSFDAFDI |
| Antibody 27 | 1637 | GYTFTGYY | 1746 | INPKSGGT | 1855 | ATGGSFDAFDI |
| Antibody 28 | 1638 | GYTFTGYY | 1747 | INPKSGGT | 1856 | ATGGSFDAFDI |
| Antibody 29 | 1639 | GYTFTGYY | 1748 | INPKSGGT | 1857 | ATGGSFDAFDI |
| Antibody 30 | 1640 | GYTFTGYY | 1749 | INPKSGGT | 1858 | AVGGSYDAFDI |
| Antibody 31 | 1641 | GYTFTGYY | 1750 | INPKSGGT | 1859 | AVGGSYDAFDI |
| Antibody 32 | 1642 | GYTFTAYY | 1751 | INPNSGGT | 1860 | AVGGSFDAFDI |
| Antibody 33 | 1643 | GYTFTAYY | 1752 | INPKSGGT | 1861 | AVGGSFDAFDI |
| Antibody 34 | 1644 | GYTFTGYY | 1753 | INPKSGGT | 1862 | ATGGSFDAFDI |
| Antibody 35 | 1645 | GYTFTGYY | 1754 | INPNSGGT | 1863 | AVGGSYDAFDI |
| Antibody 36 | 1646 | GYTFTGYY | 1755 | INPKSGGT | 1864 | AVGGSYDAFDI |
| Antibody 37 | 1647 | GYTFTAYY | 1756 | INPNSGGT | 1865 | AVGGSYDAFDI |
| Antibody 38 | 1648 | GYTFTAYY | 1757 | INPKSGGT | 1866 | AVGGSYDAFDI |
| Antibody 39 | 1649 | GYTFTAYY | 1758 | INPNSGGT | 1867 | ASGGSFDAFDI |
| Antibody 40 | 1650 | GYTFTAYY | 1759 | INPKSGGT | 1868 | ASGGSFDAFDI |
| Antibody 41 | 1651 | GYTFTGYF | 1760 | INPKSGGT | 1869 | AVGGSYDAFDI |
| Antibody 42 | 1652 | GYTFTAYY | 1761 | INPNSGGT | 1870 | AVGGSYDAFDI |
| Antibody 43 | 1653 | GYTFTAYY | 1762 | INPKSGGT | 1871 | AVGGSYDAFDI |
| Antibody 44 | 1654 | GYTFTAYY | 1763 | INPNSGGT | 1872 | AVGGSFDAFDI |
| Antibody 45 | 1655 | GYTFTAYY | 1764 | INPKSGGT | 1873 | AVGGSFDAFDI |
| Antibody 46 | 1656 | GYTFTAYY | 1765 | VNPNSGGT | 1874 | AVGGSFDAFDI |
| Antibody 47 | 1657 | GYTFTAYY | 1766 | VNPKSGGT | 1875 | AVGGSFDAFDI |

TABLE 1.3 C-continued

AMINO ACID SEQUENCES OF EXEMPLARY CDRS OF ANTIBODY 11-119
IMGT Numbering

| Name | CDRH1 SEQ ID NO | CDRH1 | CDRH2 SEQ ID NO | CDRH2 | CDRH3 SEQ ID NO | CDRH3 |
|---|---|---|---|---|---|---|
| Antibody 48 | 1658 | GYTFTAYY | 1767 | INPNSGGT | 1876 | ATGGSFDAFDI |
| Antibody 49 | 1659 | GYTFTAYY | 1768 | INPKSGGT | 1877 | ATGGSFDAFDI |
| Antibody 50 | 1660 | GYTFTGYY | 1769 | INPKSGGT | 1878 | AVGGSYDAFDI |
| Antibody 51 | 1661 | GYTFTGYY | 1770 | INPNSGGT | 1879 | AVGGSYDAFDI |
| Antibody 52 | 1662 | GYTFTGYY | 1771 | INPKSGGT | 1880 | AVGGSYDAFDI |
| Antibody 53 | 1663 | GYTFTGYY | 1772 | IHPNSGGT | 1881 | AVGGSYDAFDI |
| Antibody 54 | 1664 | GYTFTGYY | 1773 | IHPKSGGT | 1882 | AVGGSYDAFDI |
| Antibody 55 | 1665 | GYTFTGYF | 1774 | INPKSGGT | 1883 | ASGGSFDAFDI |
| Antibody 56 | 1666 | GYTFTGYY | 1775 | INPNSGGT | 1884 | ATGGSFDAFDI |
| Antibody 57 | 1667 | GYTFTGYY | 1776 | INPKSGGT | 1885 | ATGGSFDAFDI |
| Antibody 58 | 1668 | GYTFTGYY | 1777 | INPNSGGP | 1886 | ATGGSFDAFDI |
| Antibody 59 | 1669 | GYTFTGYY | 1778 | INPKSGGP | 1887 | ATGGSFDAFDI |
| Antibody 60 | 1670 | GYTFTGYF | 1779 | INPNSGGT | 1888 | ATGGSFDAFDI |
| Antibody 61 | 1671 | GYTFTGYF | 1780 | INPKSGGT | 1889 | ATGGSFDAFDI |
| Antibody 62 | 1672 | GYTFTGYY | 1781 | INPNSGGT | 1890 | ATGGSFDAFDV |
| Antibody 63 | 1673 | GYTFTGYY | 1782 | INPKSGGT | 1891 | ATGGSFDAFDV |
| Antibody 64 | 1674 | GYTFTGYY | 1783 | INPNSGGT | 1892 | ATGGSFDAFDI |
| Antibody 65 | 1675 | GYTFTGYY | 1784 | INPKSGGT | 1893 | ATGGSFDAFDI |
| Antibody 66 | 1676 | GYTFTGYY | 1785 | IKPNSGGT | 1894 | AVGGSYDAFDI |
| Antibody 67 | 1677 | GYTFTGYY | 1786 | IKPKSGGT | 1895 | AVGGSYDAFDI |
| Antibody 68 | 1678 | GYTFTAYY | 1787 | VNPNSGGT | 1896 | AVGGSFDAFDI |
| Antibody 69 | 1679 | GYTFTAYY | 1788 | VNPKSGGT | 1897 | AVGGSFDAFDI |
| Antibody 70 | 1680 | GYTFTGYY | 1789 | INPNSGGT | 1898 | ATGGSFDAFDI |
| Antibody 71 | 1681 | GYTFTGYY | 1790 | INPKSGGT | 1899 | ATGGSFDAFDI |

TABLE 1.3 C-continued

AMINO ACID SEQUENCES OF EXEMPLARY CDRS OF ANTIBODY 11-119
IMGT Numbering

| Name | CDRH1 SEQ ID NO | CDRH1 | CDRH2 SEQ ID NO | CDRH2 | CDRH3 SEQ ID NO | CDRH3 |
|---|---|---|---|---|---|---|
| Antibody 72 | 1682 | GYTFTGYY | 1791 | INPNSGGT | 1900 | ATGGSFDAFDI |
| Antibody 73 | 1683 | GYTFTGYY | 1792 | INPKSGGT | 1901 | ATGGSFDAFDI |
| Antibody 74 | 1684 | GYTFTGYY | 1793 | IKPNSGGT | 1902 | AVGGSYDAFDI |
| Antibody 75 | 1685 | GYTFTGYY | 1794 | IKPKSGGT | 1903 | AVGGSYDAFDI |
| Antibody 76 | 1686 | GYTFTGYY | 1795 | INPNSGGT | 1904 | ATGGSFDAFDI |
| Antibody 77 | 1687 | GYTFTGYY | 1796 | INPKSGGT | 1905 | ATGGSFDAFDI |
| Antibody 78 | 1688 | GYTFTAYY | 1797 | INPNSGGT | 1906 | AVGGSYDAFDI |
| Antibody 79 | 1689 | GYTFTAYY | 1798 | INPKSGGT | 1907 | AVGGSYDAFDI |
| Antibody 80 | 1690 | GYTFTGYY | 1799 | INPNSGGT | 1908 | ATGGSFDAFDI |
| Antibody 81 | 1691 | GYTFTGYY | 1800 | INPNSGGT | 1909 | AVGGSYDAFDI |
| Antibody 82 | 1692 | GYTFTGYY | 1801 | INPKSGGT | 1910 | AVGGSYDAFDI |
| Antibody 83 | 1693 | GYTFTGYY | 1802 | INPNSGAT | 1911 | ATGGSFDAFDI |
| Antibody 84 | 1694 | GYTFTGYY | 1803 | INPKSGAT | 1912 | ATGGSFDAFDI |
| Antibody 85 | 1695 | GYTFTAYY | 1804 | INPNSGGT | 1913 | AVGGSYDAFDI |
| Antibody 86 | 1696 | GYTFTAYY | 1805 | INPKSGGT | 1914 | AVGGSYDAFDI |
| Antibody 87 | 1697 | GYTFTAYY | 1806 | INPNSGGT | 1915 | AVGGSYDAFDI |
| Antibody 88 | 1698 | GYTFTAYY | 1807 | INPKSGGT | 1916 | AVGGSYDAFDI |
| Antibody 89 | 1699 | GYTFTGYY | 1808 | INPKSGGT | 1917 | ATGGSYDAFDI |
| Antibody 90 | 1700 | GYTFTGYY | 1809 | INPKSGGT | 1918 | ATGGSYDAFDI |
| Antibody 91 | 1701 | GYTFTAYY | 1810 | INPNSGGT | 1919 | AVGGSFDAFDI |
| Antibody 92 | 1702 | GYTFTAYY | 1811 | INPKSGGT | 1920 | AVGGSFDAFDI |
| Antibody 93 | 1703 | GYTFTGYY | 1812 | INPNSGGT | 1921 | AVGGSFDAFDI |
| Antibody 94 | 1704 | GYTFTGYY | 1813 | INPKSGGT | 1922 | AVGGSFDAFDI |
| Antibody 95 | 1705 | GYTFTGYY | 1814 | INPNSGGT | 1923 | ATGGSFDAFDI |

TABLE 1.3 C-continued

AMINO ACID SEQUENCES OF EXEMPLARY CDRS OF ANTIBODY 11-119
IMGT Numbering

| Name | CDRH1 SEQ ID NO | CDRH1 | CDRH2 SEQ ID NO | CDRH2 | CDRH3 SEQ ID NO | CDRH3 |
|---|---|---|---|---|---|---|
| Antibody 96 | 1706 | GYTFTGYY | 1815 | INPKSGGT | 1924 | ATGGSFDAFDI |
| Antibody 97 | 1707 | GYTFTAYY | 1816 | INPNSGGT | 1925 | AVGGSYDAFDI |
| Antibody 98 | 1708 | GYTFTGYF | 1817 | INPKSGGT | 1926 | ASGGSFDAFDI |
| Antibody 99 | 1709 | GYTFTGYY | 1818 | INPNSGGT | 1927 | ATGGSFDAFDI |
| Antibody 100 | 1710 | GYTFTGYY | 1819 | INPNSGGT | 1928 | ASGGSFDAFDI |
| Antibody 101 | 1711 | GYTFTGYY | 1820 | INPNSGGT | 1929 | AVGGSYDAFDI |
| Antibody 102 | 1712 | GYTFNGYY | 1821 | INPNSGGT | 1930 | ATGGSFDAFDI |
| Antibody 103 | 1713 | GYTFTGYY | 1822 | INPNSGGT | 1931 | AVGGSYDAFDI |
| Antibody 104 | 1714 | GYTFTAYY | 1823 | INPNSGGT | 1932 | ASGGSIDAFDI |
| Antibody 105 | 1715 | GYTFTAYY | 1824 | INPNSGGT | 1933 | AVGGSYDAFDI |
| Antibody 106 | 1716 | GYTFTGYY | 1825 | INPNSGGT | 1934 | AVGGSFDAFDI |
| Antibody 107 | 1717 | GYTFTGYY | 1826 | INPNSGGT | 1935 | VTGGSFDAFDV |
| Antibody 108 | 1718 | GYTFTGYY | 1827 | INPNSGGT | 1936 | TSGGSFDAFDI |
| Antibody 109 | 1719 | GYTFTAYY | 1828 | INPNSGGT | 1937 | ATGGSFDAFDI |
| Antibody 110 | 1720 | GYTFTGYY | 1829 | INPKSGGT | 1938 | ASGGSFDAFDI |
| Antibody 111 | 1721 | GYTFTAYY | 1830 | INPNSGGT | 1939 | AVGGSFDAFDI |
| Antibody 112 | 1722 | GYTFTGYY | 1831 | INPNSGGT | 1940 | ATGGSYDAFDI |
| Antibody 113 | 1723 | GYTFTGYY | 1832 | INPNSGGT | 1941 | ATGGSYDAFDI |
| Antibody 114 | 1724 | GYTFTGYY | 1833 | INPKSGGT | 1942 | ATGGSFDAFDI |
| Antibody 115 | 1725 | GYTFTRYG | 1834 | INTNTGNP | 1943 | ARDNWNYVSDY |
| Antibody 116 | 1726 | GYTFTGYY | 1835 | INPKSGGT | 1944 | ATGGSFDAFDI |
| Antibody 117 | 1727 | GYTFTVYY | 1836 | INPNSGGT | 1945 | ASGGSFDAFDI |
| Antibody 118 | 1728 | GYTFTRYG | 1837 | INTNTGNP | 1946 | ARDNWNYDFDY |
| Antibody 119 | 1729 | GYTFTTYG | 1838 | INTNTGNP | 1947 | ARDNWNYDLDY |

TABLE 1.3 C-continued

AMINO ACID SEQUENCES OF EXEMPLARY CDRS OF ANTIBODY 11-119
IMGT Numbering

| Name | CDRH1 SEQ ID NO | CDRH1 | CDRH2 SEQ ID NO | CDRH2 | CDRH3 SEQ ID NO | CDRH3 |
|---|---|---|---|---|---|---|
| Antibody 11 | 1948 | QSISRY | | GAS | 2166 | QQGFSAPLT |
| Antibody 12 | 1949 | QSIRRY | | AAS | 2167 | QQSYRTIT |
| Antibody 13 | 1950 | QSISRY | | GAS | 2168 | QQGDSSPFT |
| Antibody 14 | 1951 | QSISRY | | GAS | 2169 | QQGDSSPFT |
| Antibody 15 | 1952 | QSISSY | | GAS | 2170 | QQGHSTPFT |
| Antibody 16 | 1953 | QSISRY | | GAS | 2171 | QQGDSSPFT |
| Antibody 17 | 1954 | QSISRY | | GAS | 2172 | QQGDSSPFT |
| Antibody 18 | 1955 | QSISSY | | GAS | 2173 | QQGHSTPFT |
| Antibody 19 | 1956 | QSISSY | | GAS | 2174 | QQGHSTPFT |
| Antibody 20 | 1957 | QSISSY | | GAS | 2175 | QQGDSTPFT |
| Antibody 21 | 1958 | QSISSY | | GAS | 2176 | QQGDSTPFT |
| Antibody 22 | 1959 | QSISSY | | GAS | 2177 | QQGDSTPFT |
| Antibody 23 | 1960 | QSISSY | | GAS | 2178 | QQGDSTPFT |
| Antibody 24 | 1961 | QSISSY | | GAS | 2179 | QQGDSTPFT |
| Antibody 25 | 1962 | QSISSY | | GAS | 2180 | QQGDSTPFT |
| Antibody 26 | 1963 | QSISSY | | GAS | 2181 | QQGDSSPFT |
| Antibody 27 | 1964 | QSISSY | | GAS | 2182 | QQGDSSPFT |
| Antibody 28 | 1965 | QSISSY | | GAS | 2183 | QQGHSTPFT |
| Antibody 29 | 1966 | QSISSY | | GAS | 2184 | QQGDSTPFT |
| Antibody 30 | 1967 | QSISSY | | GAS | 2185 | QQGHSTPFT |
| Antibody 31 | 1968 | QSISSY | | GAS | 2186 | QQGYSSPFT |
| Antibody 32 | 1969 | QDISNY | | GAS | 2187 | QQGDSTPFT |
| Antibody 33 | 1970 | QDISNY | | GAS | 2188 | QQGDSTPFT |
| Antibody 34 | 1971 | QGISRY | | GAS | 2189 | QQGFSTPFT |

TABLE 1.3 C-continued

AMINO ACID SEQUENCES OF EXEMPLARY CDRS OF ANTIBODY 11-119
IMGT Numbering

| Name | CDRH1 SEQ ID NO | CDRH1 | CDRH2 SEQ ID NO | CDRH2 | CDRH3 SEQ ID NO | CDRH3 |
|---|---|---|---|---|---|---|
| Antibody 35 | 1972 | QSISSY | | GAS | 2190 | QQGSSPPFT |
| Antibody 36 | 1973 | QSISSY | | GAS | 2191 | QQGSSPPFT |
| Antibody 37 | 1974 | QSISSY | | GAS | 2192 | QQGYSSPFT |
| Antibody 38 | 1975 | QSISSY | | GAS | 2193 | QQGYSSPFT |
| Antibody 39 | 1976 | QSISRY | | GAS | 2194 | QQGDSSPFT |
| Antibody 40 | 1977 | QSISRY | | GAS | 2195 | QQGDSSPFT |
| Antibody 41 | 1978 | QSISSY | | GAS | 2196 | QQGHSTPFT |
| Antibody 42 | 1979 | QSISSY | | GAS | 2197 | QQGDSTPFT |
| Antibody 43 | 1980 | QSISSY | | GAS | 2198 | QQGDSTPFT |
| Antibody 44 | 1981 | QSISSY | | GAS | 2199 | QQGYSSPFT |
| Antibody 45 | 1982 | QSISSY | | GAS | 2200 | QQGYSSPFT |
| Antibody 46 | 1983 | QSISSY | | GAS | 2201 | QQGHSTPFT |
| Antibody 47 | 1984 | QSISSY | | GAS | 2202 | QQGHSTPFT |
| Antibody 48 | 1985 | QSISSY | | GAS | 2203 | QQGDSTPFT |
| Antibody 49 | 1986 | QSISSY | | GAS | 2204 | QQGDSTPFT |
| Antibody 50 | 1987 | QSISSY | | GAS | 2205 | QQGDSTPFT |
| Antibody 51 | 1988 | QSISSY | | GAS | 2206 | QQGDSTPFT |
| Antibody 52 | 1989 | QSISSY | | GAS | 2207 | QQGDSTPFT |
| Antibody 53 | 1990 | QSISSY | | GAS | 2208 | QQGYSSPFT |
| Antibody 54 | 1991 | QSISSY | | GAS | 2209 | QQGYSSPFT |
| Antibody 55 | 1992 | QSISRY | | GAS | 2210 | QQGDSSPFT |
| Antibody 56 | 1993 | QSISSY | | GAS | 2211 | QQGYSSPFT |
| Antibody 57 | 1994 | QSISSY | | GAS | 2212 | QQGYSSPFT |
| Antibody 58 | 1995 | QSISNY | | GTS | 2213 | QQGYSSPFT |

TABLE 1.3 C-continued

AMINO ACID SEQUENCES OF EXEMPLARY CDRS OF ANTIBODY 11-119
IMGT Numbering

| Name | CDRH1 SEQ ID NO | CDRH1 | CDRH2 SEQ ID NO | CDRH2 | CDRH3 SEQ ID NO | CDRH3 |
|---|---|---|---|---|---|---|
| Antibody 59 | 1996 | QSISNY | | GTS | 2214 | QQGYSSPFT |
| Antibody 60 | 1997 | QSISSY | | GAS | 2215 | QQGYSSPFT |
| Antibody 61 | 1998 | QSISSY | | GAS | 2216 | QQGYSSPFT |
| Antibody 62 | 1999 | QSISSY | | GAS | 2217 | QQGDNTPFT |
| Antibody 63 | 2000 | QSISSY | | GAS | 2218 | QQGDNTPFT |
| Antibody 64 | 2001 | QSISSY | | GAS | 2219 | QQGHSTPFT |
| Antibody 65 | 2002 | QSISSY | | GAS | 2220 | QQGHSTPFT |
| Antibody 66 | 2003 | QSISSY | | GAS | 2221 | QQGYSSPFT |
| Antibody 67 | 2004 | QSISSY | | GAS | 2222 | QQGYSSPFT |
| Antibody 68 | 2005 | QSISSY | | GAS | 2223 | QQGHSTPFT |
| Antibody 69 | 2006 | QSISSY | | GAS | 2224 | QQGHSTPFT |
| Antibody 70 | 2007 | QTISSY | | GAS | 2225 | QQGDSTPFT |
| Antibody 71 | 2008 | QTISSY | | GAS | 2226 | QQGDSTPFT |
| Antibody 72 | 2009 | QSISKY | | GAS | 2227 | QQGHSTPFT |
| Antibody 73 | 2010 | QSISKY | | GAS | 2228 | QQGHSTPFT |
| Antibody 74 | 2011 | QSISSY | | GAS | 2229 | QQGDSTPFT |
| Antibody 75 | 2012 | QSISSY | | GAS | 2230 | QQGDSTPFT |
| Antibody 76 | 2013 | QSISSY | | GAS | 2231 | QQGYSSPFT |
| Antibody 77 | 2014 | QSISSY | | GAS | 2232 | QQGYSSPFT |
| Antibody 78 | 2015 | LSISSY | | GAS | 2233 | QQGHSTPFT |
| Antibody 79 | 2016 | LSISSY | | GAS | 2234 | QQGHSTPFT |
| Antibody 80 | 2017 | QSISSY | | GAS | 2235 | QQGDSTPFT |
| Antibody 81 | 2018 | QSISSY | | GAS | 2236 | QQGDSTPFT |
| Antibody 82 | 2019 | QSISSY | | GAS | 2237 | QQGDSTPFT |

TABLE 1.3 C-continued

AMINO ACID SEQUENCES OF EXEMPLARY CDRS OF ANTIBODY 11-119
IMGT Numbering

| Name | CDRH1 SEQ ID NO | CDRH1 | CDRH2 SEQ ID NO | CDRH2 | CDRH3 SEQ ID NO | CDRH3 |
|---|---|---|---|---|---|---|
| Antibody 83 | 2020 | RSISSY | | GAS | 2238 | QQGYSSPFT |
| Antibody 84 | 2021 | RSISSY | | GAS | 2239 | QQGYSSPFT |
| Antibody 85 | 2022 | QSINSY | | GAS | 2240 | QQGYSTPFT |
| Antibody 86 | 2023 | QSIQSY | | GAS | 2241 | QQGYSTPFT |
| Antibody 87 | 2024 | QSISSY | | GAS | 2242 | QQGDNTPFT |
| Antibody 88 | 2025 | QSISSY | | GAS | 2243 | QQGDNTPFT |
| Antibody 89 | 2026 | QSINSY | | GAS | 2244 | QQGYSTPFT |
| Antibody 90 | 2027 | QSIQSY | | GAS | 2245 | QQGYSTPFT |
| Antibody 91 | 2028 | QSISSY | | GAS | 2246 | QQGDSTPFT |
| Antibody 92 | 2029 | QSISSY | | GAS | 2247 | QQGDSTPFT |
| Antibody 93 | 2030 | LSISSY | | GAS | 2248 | QQGHSTPFT |
| Antibody 94 | 2031 | LSISSY | | GAS | 2249 | QQGHSTPFT |
| Antibody 95 | 2032 | QSISSY | | GAS | 2250 | QQGYSSPFT |
| Antibody 96 | 2033 | QTISRY | | GAS | 2251 | QQSYSTPFT |
| Antibody 97 | 2034 | QTISRY | | GAS | 2252 | QQGYSTPFT |
| Antibody 98 | 2035 | QSISSY | | GAS | 2253 | QQGDSTPFT |
| Antibody 99 | 2036 | QSISSY | | GAS | 2254 | QQGYSSPFT |
| Antibody 100 | 2037 | QSISRY | | GAS | 2255 | QQGDSSPFT |
| Antibody 101 | 2038 | QSISRY | | GAS | 2256 | QQGYSTLFT |
| Antibody 102 | 2039 | QSISSY | | GAS | 2257 | QQGYSSPFT |
| Antibody 103 | 2040 | QSISSY | | GAS | 2258 | QQGYSNPFT |
| Antibody 104 | 2041 | QSISSY | | GAS | 2259 | QQGFSTPFT |
| Antibody 105 | 2042 | QSISSY | | GAS | 2260 | QQGYSSPFT |
| Antibody 106 | 2043 | QSISRY | | GAS | 2261 | QQGYSSPFT |

TABLE 1.3 C-continued

AMINO ACID SEQUENCES OF EXEMPLARY CDRS OF ANTIBODY 11-119
IMGT Numbering

| Name | CDRH1 SEQ ID NO | CDRH1 | CDRH2 SEQ ID NO | CDRH2 | CDRH3 SEQ ID NO | CDRH3 |
|---|---|---|---|---|---|---|
| Antibody 107 | 2044 | QSISSY | | GAS | 2262 | QQGDSTPFT |
| Antibody 108 | 2045 | QSISSF | | GAS | 2263 | QQGDSTPFT |
| Antibody 109 | 2046 | QSISSY | | GAS | 2264 | QQGHSTPFT |
| Antibody 110 | 2047 | QSISSY | | GAS | 2265 | QQGHSTPFT |
| Antibody 111 | 2048 | QSISSY | | GAS | 2266 | QQGHSTPIT |
| Antibody 112 | 2049 | QSISSY | | GAS | 2267 | QQGYSSPFT |
| Antibody 113 | 2050 | QSISRY | | AAS | 2268 | QQGYDTPFT |
| Antibody 114 | 2051 | QDISNY | | AAS | 2269 | QQGDSTPFT |
| Antibody 115 | 2052 | QSVSDSY | | GAS | 2270 | QQYGTSPIT |
| Antibody 116 | 2053 | QSISSY | | GAS | 2271 | QQAKSFPLT |
| Antibody 117 | 2054 | QSISSY | | GAS | 2272 | QQGYSSPFT |
| Antibody 118 | 2055 | QSLVHSDGNTY | | KIS | 2273 | MQVTQFPIT |
| Antibody 119 | 2056 | QSLVHSDGNTY | | KIS | 2274 | MQATQFPIT |

In some embodiments, the TL1A binding protein comprises a heavy chain variable region comprising a CDR1, CDR2, and CDR3 as listed in TABLE 1.1 A, TABLE 1.1 B, TABLE 1.1 C, TABLE 1.2 A, TABLE 1.2 B, TABLE 1.2 C, TABLE 1.3 A, TABLE 1.3 B, and TABLE 1.3 C. In some embodiments, the TL1A binding protein comprises a heavy chain variable region comprising (i) a CDR1 having an amino acid sequence according to any one of CDRH1 sequences listed in TABLE 1.1 A, TABLE 1.1 B, and TABLE 1.1 C, (ii) a CDR2 having an amino acid sequence according to any one of CDRH2 sequences listed in TABLE 1.1 A, TABLE 1.1 B, and TABLE 1.1 C, and (iii) a CDR3 having an amino acid sequence according to any one of CDRH3 sequences listed in TABLE 1.1 A, TABLE 1.1 B, and TABLE 1.1 C. In some embodiments, the TL1A binding protein comprises a heavy chain variable region comprising (i) a CDR1 having an amino acid sequence according to any one of SEQ ID NOs: 1-10 and 313-421, (ii) a CDR2 having an amino acid sequence according to any one of SEQ ID NOs: 11-20 and 422-530, and (iii) a CDR3 having an amino acid sequence according to any one of SEQ ID NOs: 21-30 and 531-639.

In some embodiments, the TL1A binding protein comprises a light chain variable region comprising a CDR1, CDR2, and CDR3 as listed in TABLE 1.1 A, TABLE 1.1 B, TABLE 1.1 C, TABLE 1.2 A, TABLE 1.2 B, TABLE 1.2 C, TABLE 1.3 A, TABLE 1.3 B, and TABLE 1.3 C. In some embodiments, the TL1A binding protein comprises a light chain variable region comprising (i) a CDR1 having an amino acid sequence according to any one of CDRL1 sequences listed in TABLE 1.1 A, TABLE 1.1 B, and TABLE 1.1 C, (ii) a CDR2 having an amino acid sequence according to any one of CDRL2 sequences listed in TABLE 1.1 A, TABLE 1.1 B, and TABLE 1.1 C, and (iii) a CDR3 having an amino acid sequence according to any one of CDRL3 sequences listed in TABLE 1.1 A, TABLE 1.1 B, and TABLE 1.1 C. In some embodiments, the TL1A binding protein comprises a light chain variable region comprising (i) a CDR1 having an amino acid sequence according to any one of SEQ ID NOs: 31-40 and 640-748, (ii) a CDR2 having an amino acid sequence according to any one of SEQ ID NOs: 41-50 and 749-857, and (iii) a CDR3 having an amino acid sequence according to any one of SEQ ID NOs: 51-60 and 858-966.

In some embodiments, the TL1A binding protein comprises a) a heavy chain variable region (VH) comprising (i) a CDR1 having an amino acid sequence according to any one of SEQ ID NOs: 1-10 and 313-421, (ii) a CDR2 having an amino acid sequence according to any one of SEQ ID NOs: 11-20 and 422-530, and (iii) a CDR3 having an amino acid sequence according to any one of SEQ ID NOs: 21-30 and 531-639; and b) a light chain variable region (VL)

comprising (i) a CDR1 having an amino acid sequence according to any one of SEQ ID NOs: 31-40 and 640-748, (ii) a CDR2 having an amino acid sequence according to any one of SEQ ID NOs: 41-50 and 749-857, and (iii) a CDR3 having an amino acid sequence according to any one of SEQ ID NOs: 51-60 and 858-966. In some embodiments, the TL1A binding protein comprises a) a heavy chain variable region (VH) comprising (i) a CDR1 having an amino acid sequence according to any one of CDRH1 sequences listed in TABLE 1.1 A, TABLE 1.1 B, and TABLE 1.1 C, (ii) a CDR2 having an amino acid sequence according to any one of CDRH2 sequences listed in TABLE 1.1 A, TABLE 1.1 B, and TABLE 1.1 C, and (iii) a CDR3 having an amino acid sequence according to any one of CDRH3 sequences listed in TABLE 1.1 A. TABLE 1.1 B, and TABLE 1.1 C; and b) a light chain variable region (VL) comprising (i) a CDR1 having an amino acid sequence according to any one of CDRL1 sequences listed in TABLE 1.1 A, TABLE 1.1 B, and TABLE 1.1 C, (ii) a CDR2 having an amino acid sequence according to any one of CDRL2 sequences listed in TABLE 1.1 A, TABLE 1.1 B, and TABLE 1.1 C, and (iii) a CDR3 having an amino acid sequence according to any one of CDRL3 sequences listed in TABLE 1.1 A, TABLE 1.1 B, and TABLE 1.1 C. In some embodiments, the TL1A binding protein described herein, wherein the VH comprises a sequence having at least 80% sequence identity to any one of the amino acid sequences listed in TABLE 2.1 and TABLE 2.2, and the VL comprises a sequence having at least 80% sequence identity to any one of the amino acid sequences listed in TABLE 2.1 and TABLE 2.2.

In some embodiments, the TL1A binding protein comprises a heavy chain variable region comprising (i) a CDR1 having an amino acid sequence according to any one of SEQ ID NOs: 61-70 and 967-1075, (ii) a CDR2 having an amino acid sequence according to any one of SEQ ID NOs: 71-80 and 1076-1184, and (iii) a CDR3 having an amino acid sequence according to any one of SEQ ID NOs: 81-90 and 1185-1293.

In some embodiments, the TL1A binding protein comprises a light chain variable region comprising (i) a CDR1 having an amino acid sequence according to any one of SEQ ID NOs: 91-100 and 1294-1402, (ii) a CDR2 having an amino acid sequence according to any one of CDRL2 sequences listed in TABLE 1.2 A, TABLE 1.2 B, and TABLE 1.2 C, and (iii) a CDR3 having an amino acid sequence according to any one of SEQ ID NOs: 111-120 and 1512-1620.

In some embodiments, the TL1A binding protein comprises a) a heavy chain variable region comprising i) a CDR1 having an amino acid sequence according to any one of SEQ ID NOs: 61-70 and 967-1075, (ii) a CDR2 having an amino acid sequence according to any one of SEQ ID NOs: 71-80 and 1076-1184, and (iii) a CDR3 having an amino acid sequence according to any one of SEQ ID NOs: 81-90 and 1185-1293; and b) a light chain variable region comprising (i) a CDR1 having an amino acid sequence according to any one of SEQ ID NOS: 91-100 and 1294-1402, (ii) a CDR2 having an amino acid sequence according to any one of CDRL2 sequences listed in TABLE 1.2 A, TABLE 1.2 B, and TABLE 1.2 C, and (iii) a CDR3 having an amino acid sequence according to any one of SEQ ID NOs: 111-120 and 1512-1620.

In some embodiments, the TL1A binding protein comprises a heavy chain variable region comprising (i) a CDR1 having an amino acid sequence according to any one of SEQ ID NOs: 121-130 and 1621-1729, (ii) a CDR2 having an amino acid sequence according to any one of SEQ ID NOs: 131-140 and 1730-1838, and (iii) a CDR3 having an amino acid sequence according to any one of SEQ ID NOs: 141-150 and 1839-1947.

In some embodiments, the TL1A binding protein comprises a light chain variable region comprising (i) a CDR1 having an amino acid sequence according to any one of SEQ ID NOs: 151-160 and 1948-2056, (ii) a CDR2 having an amino acid sequence according to any one of CDRL2 sequences listed in TABLE 1.3 A, TABLE 1.3 B, and TABLE 1.3 C, and (iii) a CDR3 having an amino acid sequence according to any one of SEQ ID NOs: 171-180 and 2166-2274.

In some embodiments, the TL1A binding protein comprises a) a heavy chain variable region comprising (i) a CDR1 having an amino acid sequence according to any one of SEQ ID NOs: 121-130 and 1621-1729, (ii) a CDR2 having an amino acid sequence according to any one of SEQ ID NOs: 131-140 and 1730-1838, and (iii) a CDR3 having an amino acid sequence according to any one of SEQ ID NOs: 141-150 and 1839-1947; and b) a light chain variable region comprising (i) a CDR1 having an amino acid sequence according to any one of SEQ ID NOs: 151-160 and 1948-2056, (ii) a CDR2 having an amino acid sequence according to any one of CDRL2 sequences listed in TABLE 1.3 A, TABLE 1.3 B, and TABLE 1.3 C, and (iii) a CDR3 having an amino acid sequence according to any one of SEQ ID NOs: 171-180 and 2166-2274.

In some embodiments, the TL1A binding protein comprises a) a heavy chain variable region (VH) comprising (i) a CDR1 having an amino acid sequence according to SEQ ID NO: 1, (ii) a CDR2 having an amino acid sequence according to SEQ ID NO: 11, and (iii) a CDR3 having an amino acid sequence according to SEQ ID NO: 21; and b) a light chain variable region (VL) comprising (i) a CDR1 having an amino acid sequence according to SEQ ID NO: 31, (ii) a CDR2 having an amino acid sequence according to SEQ ID NO: 41, and (iii) a CDR3 having an amino acid sequence according to SEQ ID NO: 51.

In some embodiments, the TL1A binding protein comprises a) a heavy chain variable region (VH) comprising (i) a CDR1 having an amino acid sequence according to SEQ ID NO: 2, (ii) a CDR2 having an amino acid sequence according to SEQ ID NO: 12, and (iii) a CDR3 having an amino acid sequence according to SEQ ID NO: 22; and b) a light chain variable region (VL) comprising (i) a CDR1 having an amino acid sequence according to SEQ ID NO: 32, (ii) a CDR2 having an amino acid sequence according to SEQ ID NO: 42, and (iii) a CDR3 having an amino acid sequence according to SEQ ID NO: 52.

In some embodiments, the TL1A binding protein comprises a) a heavy chain variable region (VH) comprising (i) a CDR1 having an amino acid sequence according to SEQ ID NO: 3, (ii) a CDR2 having an amino acid sequence according to SEQ ID NO: 13, and (iii) a CDR3 having an amino acid sequence according to SEQ ID NO: 23; and b) a light chain variable region (VL) comprising (i) a CDR1 having an amino acid sequence according to SEQ ID NO: 33, (ii) a CDR2 having an amino acid sequence according to SEQ ID NO: 43, and (iii) a CDR3 having an amino acid sequence according to SEQ ID NO: 53.

In some embodiments, the TL1A binding protein comprises a) a heavy chain variable region (VH) comprising (i) a CDR1 having an amino acid sequence according to SEQ ID NO: 4, (ii) a CDR2 having an amino acid sequence according to SEQ ID NO: 14, and (iii) a CDR3 having an amino acid sequence according to SEQ ID NO: 24; and b) a light chain variable region (VL) comprising (i) a CDR1 having an amino acid sequence according to SEQ ID NO: 34, (ii) a CDR2 having an amino acid sequence according to SEQ ID NO: 44, and (iii) a CDR3 having an amino acid sequence according to SEQ ID NO: 54.

In some embodiments, the TL1A binding protein comprises a) a heavy chain variable region (VH) comprising (i) a CDR1 having an amino acid sequence according to SEQ ID NO: 5, (ii) a CDR2 having an amino acid sequence according to SEQ ID NO: 15, and (iii) a CDR3 having an amino acid sequence according to SEQ ID NO: 25; and b) a light chain variable region (VL) comprising (i) a CDR1 having an amino acid sequence according to SEQ ID NO: 35, (ii) a CDR2 having an amino acid sequence according to SEQ ID NO: 45, and (iii) a CDR3 having an amino acid sequence according to SEQ ID NO: 55.

In some embodiments, the TL1A binding protein comprises a) a heavy chain variable region (VH) comprising (i) a CDR1 having an amino acid sequence according to SEQ ID NO: 6, (ii) a CDR2 having an amino acid sequence according to SEQ ID NO: 16, and (iii) a CDR3 having an amino acid sequence according to SEQ ID NO: 26; and b) a light chain variable region (VL) comprising (i) a CDR1 having an amino acid sequence according to SEQ ID NO: 36, (ii) a CDR2 having an amino acid sequence according to SEQ ID NO: 46, and (iii) a CDR3 having an amino acid sequence according to SEQ ID NO: 56.

In some embodiments, the TL1A binding protein comprises a) a heavy chain variable region (VH) comprising (i) a CDR1 having an amino acid sequence according to SEQ ID NO: 7, (ii) a CDR2 having an amino acid sequence according to SEQ ID NO: 17, and (iii) a CDR3 having an amino acid sequence according to SEQ ID NO: 27; and b) a light chain variable region (VL) comprising (i) a CDR1 having an amino acid sequence according to SEQ ID NO: 37, (ii) a CDR2 having an amino acid sequence according to SEQ ID NO: 47, and (iii) a CDR3 having an amino acid sequence according to SEQ ID NO: 57.

In some embodiments, the TL1A binding protein comprises a) a heavy chain variable region (VH) comprising (i) a CDR1 having an amino acid sequence according to SEQ ID NO: 8, (ii) a CDR2 having an amino acid sequence according to SEQ ID NO: 18, and (iii) a CDR3 having an amino acid sequence according to SEQ ID NO: 28; and b) a light chain variable region (VL) comprising (i) a CDR1 having an amino acid sequence according to SEQ ID NO: 38, (ii) a CDR2 having an amino acid sequence according to SEQ ID NO: 48, and (iii) a CDR3 having an amino acid sequence according to SEQ ID NO: 58.

In some embodiments, the TL1A binding protein comprises a) a heavy chain variable region (VH) comprising (i) a CDR1 having an amino acid sequence according to SEQ ID NO: 9, (ii) a CDR2 having an amino acid sequence according to SEQ ID NO: 19, and (iii) a CDR3 having an amino acid sequence according to SEQ ID NO: 29; and b) a light chain variable region (VL) comprising (i) a CDR1 having an amino acid sequence according to SEQ ID NO: 39, (ii) a CDR2 having an amino acid sequence according to SEQ ID NO: 49, and (iii) a CDR3 having an amino acid sequence according to SEQ ID NO: 59.

In some embodiments, the TL1A binding protein comprises a) a heavy chain variable region (VH) comprising (i) a CDR1 having an amino acid sequence according to SEQ ID NO: 10, (ii) a CDR2 having an amino acid sequence according to SEQ ID NO: 20, and (iii) a CDR3 having an amino acid sequence according to SEQ ID NO: 30; and b) a light chain variable region (VL) comprising (i) a CDR1 having an amino acid sequence according to SEQ ID NO: 40, (ii) a CDR2 having an amino acid sequence according to SEQ ID NO: 50, and (iii) a CDR3 having an amino acid sequence according to SEQ ID NO: 60.

In some embodiments, the TL1A binding protein comprises a) a heavy chain variable region (VH) comprising (i) a CDR1 having an amino acid sequence according to SEQ ID NO: 321, (ii) a CDR2 having an amino acid sequence according to SEQ ID NO: 430, and (iii) a CDR3 having an amino acid sequence according to SEQ ID NO: 539; and b) a light chain variable region (VL) comprising (i) a CDR1 having an amino acid sequence according to SEQ ID NO: 648, (ii) a CDR2 having an amino acid sequence according to SEQ ID NO: 757, and (iii) a CDR3 having an amino acid sequence according to SEQ ID NO: 866.

In some embodiments, the TL1A binding protein comprises a) a heavy chain variable region (VH) comprising (i) a CDR1 having an amino acid sequence according to SEQ ID NO: 341, (ii) a CDR2 having an amino acid sequence according to SEQ ID NO: 450, and (iii) a CDR3 having an amino acid sequence according to SEQ ID NO: 559; and b) a light chain variable region (VL) comprising (i) a CDR1 having an amino acid sequence according to SEQ ID NO: 668, (ii) a CDR2 having an amino acid sequence according to SEQ ID NO: 777, and (iii) a CDR3 having an amino acid sequence according to SEQ ID NO: 886.

In some embodiments, the TL1A binding protein comprises a) a heavy chain variable region (VH) comprising (i) a CDR1 having an amino acid sequence according to SEQ ID NO: 345, (ii) a CDR2 having an amino acid sequence according to SEQ ID NO: 454, and (iii) a CDR3 having an amino acid sequence according to SEQ ID NO: 563; and b) a light chain variable region (VL) comprising (i) a CDR1 having an amino acid sequence according to SEQ ID NO: 672, (ii) a CDR2 having an amino acid sequence according to SEQ ID NO: 781, and (iii) a CDR3 having an amino acid sequence according to SEQ ID NO: 890.

In some embodiments, the TL1A binding protein comprises a) a heavy chain variable region (VH) comprising (i) a CDR1 having an amino acid sequence according to SEQ ID NO: 349, (ii) a CDR2 having an amino acid sequence according to SEQ ID NO: 458, and (iii) a CDR3 having an amino acid sequence according to SEQ ID NO: 567; and b) a light chain variable region (VL) comprising (i) a CDR1 having an amino acid sequence according to SEQ ID NO: 676, (ii) a CDR2 having an amino acid sequence according to SEQ ID NO: 785, and (iii) a CDR3 having an amino acid sequence according to SEQ ID NO: 894.

In some embodiments, the TL1A binding protein comprises a) a heavy chain variable region (VH) comprising (i) a CDR1 having an amino acid sequence according to SEQ ID NO: 351, (ii) a CDR2 having an amino acid sequence according to SEQ ID NO: 460, and (iii) a CDR3 having an amino acid sequence according to SEQ ID NO: 569; and b) a light chain variable region (VL) comprising (i) a CDR1 having an amino acid sequence according to SEQ ID NO: 678, (ii) a CDR2 having an amino acid sequence according to SEQ ID NO: 787, and (iii) a CDR3 having an amino acid sequence according to SEQ ID NO: 896.

In some embodiments, the TL1A binding protein comprises a) a heavy chain variable region (VH) comprising (i) a CDR1 having an amino acid sequence according to SEQ ID NO: 354, (ii) a CDR2 having an amino acid sequence according to SEQ ID NO: 463, and (iii) a CDR3 having an amino acid sequence according to SEQ ID NO: 572; and b) a light chain variable region (VL) comprising (i) a CDR1 having an amino acid sequence according to SEQ ID NO: 681, (ii) a CDR2 having an amino acid sequence according to SEQ ID NO: 790, and (iii) a CDR3 having an amino acid sequence according to SEQ ID NO: 899.

In some embodiments, the TL1A binding protein comprises a) a heavy chain variable region (VH) comprising (i) a CDR1 having an amino acid sequence according to SEQ ID NO: 365, (ii) a CDR2 having an amino acid sequence according to SEQ ID NO: 474, and (iii) a CDR3 having an amino acid sequence according to SEQ ID NO: 583; and b) a light chain variable region (VL) comprising (i) a CDR1 having an amino acid sequence according to SEQ ID NO: 692, (ii) a CDR2 having an amino acid sequence according to SEQ ID NO: 801, and (iii) a CDR3 having an amino acid sequence according to SEQ ID NO: 910.

In some embodiments, the TL1A binding protein comprises a) a heavy chain variable region (VH) comprising (i) a CDR1 having an amino acid sequence according to SEQ ID NO: 371, (ii) a CDR2 having an amino acid sequence according to SEQ ID NO: 480, and (iii) a CDR3 having an amino acid sequence according to SEQ ID NO: 589; and b) a light chain variable region (VL) comprising (i) a CDR1 having an amino acid sequence according to SEQ ID NO: 698, (ii) a CDR2 having an amino acid sequence according to SEQ ID NO: 807, and (iii) a CDR3 having an amino acid sequence according to SEQ ID NO: 916.

In some embodiments, the TL1A binding protein comprises a) a heavy chain variable region (VH) comprising (i) a CDR1 having an amino acid sequence according to SEQ ID NO: 372, (ii) a CDR2 having an amino acid sequence according to SEQ ID NO: 481, and (iii) a CDR3 having an amino acid sequence according to SEQ ID NO: 590; and b) a light chain variable region (VL) comprising (i) a CDR1 having an amino acid sequence according to SEQ ID NO: 699, (ii) a CDR2 having an amino acid sequence according to SEQ ID NO: 808, and (iii) a CDR3 having an amino acid sequence according to SEQ ID NO: 917.

In some embodiments, the TL1A binding protein comprises a) a heavy chain variable region (VH) comprising (i) a CDR1 having an amino acid sequence according to SEQ ID NO: 373, (ii) a CDR2 having an amino acid sequence according to SEQ ID NO: 482, and (iii) a CDR3 having an amino acid sequence according to SEQ ID NO: 591; and b) a light chain variable region (VL) comprising (i) a CDR1 having an amino acid sequence according to SEQ ID NO: 700, (ii) a CDR2 having an amino acid sequence according to SEQ ID NO: 809, and (iii) a CDR3 having an amino acid sequence according to SEQ ID NO: 918.

In some embodiments, the TL1A binding protein comprises a) a heavy chain variable region (VH) comprising (i) a CDR1 having an amino acid sequence according to SEQ ID NO: 388, (ii) a CDR2 having an amino acid sequence according to SEQ ID NO: 497, and (iii) a CDR3 having an amino acid sequence according to SEQ ID NO: 606; and b) a light chain variable region (VL) comprising (i) a CDR1 having an amino acid sequence according to SEQ ID NO: 715, (ii) a CDR2 having an amino acid sequence according to SEQ ID NO: 824, and (iii) a CDR3 having an amino acid sequence according to SEQ ID NO: 933.

In some embodiments, the TL1A binding protein comprises a) a heavy chain variable region (VH) comprising (i) a CDR1 having an amino acid sequence according to SEQ ID NO: 394, (ii) a CDR2 having an amino acid sequence according to SEQ ID NO: 503, and (iii) a CDR3 having an amino acid sequence according to SEQ ID NO: 612; and b) a light chain variable region (VL) comprising (i) a CDR1 having an amino acid sequence according to SEQ ID NO: 721, (ii) a CDR2 having an amino acid sequence according to SEQ ID NO: 830, and (iii) a CDR3 having an amino acid sequence according to SEQ ID NO: 939.

In some embodiments, the TL1A binding protein comprises a) a heavy chain variable region (VH) comprising (i) a CDR1 having an amino acid sequence according to SEQ ID NO: 400, (ii) a CDR2 having an amino acid sequence according to SEQ ID NO: 509, and (iii) a CDR3 having an amino acid sequence according to SEQ ID NO: 618; and b) a light chain variable region (VL) comprising (i) a CDR1 having an amino acid sequence according to SEQ ID NO: 727, (ii) a CDR2 having an amino acid sequence according to SEQ ID NO: 836, and (iii) a CDR3 having an amino acid sequence according to SEQ ID NO: 945.

Amino acid sequences of exemplary heavy chain variable regions (VH) and light chain variable regions (VL) of TL1A binding proteins are provided in TABLE 2.1 and TABLE 2.2.

TABLE 2.1

SEQUENCES OF HEAVY CHAIN VARIABLE REGIONS (VH) AND LIGHT CHAIN VARIABLE REGIONS (VL) OF TL1A BINDING PROTEINS (ANTIBODY 5-10)

| Antibody | SEQ ID NO | VH | SEQ ID NO | VL |
|---|---|---|---|---|
| Antibody 5 | 185 | EVQLVESGGGLVKPGGS LRLSCAAFGFTFSNVWM NWVRQAPGKGLEWVGL IKSKTDAGTTDYAAPVK GRFTISRDDSKNMLYLQ MNSLKTEDTAVYYCTTD RGWGENYWGQGTLVTV SS | 195 | ENVLTQSPGTLSLSPGERATLSCR ASQIFSSSYLVWYQKKPGQAPRL LIYGASSRATGIPDRFSGSGSGTD FTLTISRLEPEDFAVYYCQQYGNS PYTFGQGTKLEIK |
| Antibody 6 | 186 | EVQLVESGGGLVKPGGS LRLSCAASGFIFSNVWM NWVRQAPGKGLEWVGR IKSKIDAGTTDYVAPVKG RFTISRDDSKNTLSLQMN SLKTEDTAVYYCITDRG WGENYWGQGTLVTVSS | 196 | EIVLTQSPGTLSLSPGERATLSCR ASQSVSSSYLVWYQQKPGQAPR LLIYGASSRATGIPDRFSGSGSGT DFTFTISRLEPEDFAVYYCQQYG GSPYTFGQGTKLEIK |

TABLE 2.1-continued

SEQUENCES OF HEAVY CHAIN VARIABLE REGIONS (VH) AND LIGHT CHAIN VARIABLE REGIONS (VL) OF TL1A BINDING PROTEINS (ANTIBODY 5-10)

| Antibody | SEQ ID NO | VH | SEQ ID NO | VL |
|---|---|---|---|---|
| Antibody 7 | 187 | EVQLVESGGGLVKPGGS LRLSCAASGFTFSNAWM SWVRQAPGKGLEWVGRI KSKIDAGTTDYAAPVKG RFTISRDDSRNTLYLQMN SLRTEDTADYYCTTDLG WGENYWGQGTLVTVSS | 197 | EIVLTQSPGTLSLSPGERATLSCR ASQSISRSYLVWYEQKPGQAPRL LIYGASSRATGIPDRFSGSGSGTD FTLTISRLEPEDFAVYYCHQYGSS PYTFGQGTKLEIK |
| Antibody 8 | 188 | EVQLVESGGGLVKPGGS LRLSCAASGFTFSNAWM SWVRQAPGKGLEWVGRI KSKIDAGTTDYAAPVKG RFTISRDDSKNTLYLQM NSLKTEDTAVYYCTTDL GWGENYWGQGTLVTVS S | 198 | ENVLTQSPGTLSLSPGERATLSCR ASQRVSSSYLVWYQQKPGQAPR LLIYGASSRATGIPDRFSGSGSGT DFTLTISRLEPEDFAVYYCQQYGS SPYTFGQGTKLESK |
| Antibody 9 | 189 | EVQLVESGGGLVKPGGS LRLSCAASGFTFSNAWM TWVRQAPGKGLEWVGR IKSKIDAGTTDYAAPVKG RFTISRYDSKNTLYLQM NSLKTEDTAVYYCTTDL GWGENYWGQGTLVTVS S | 199 | ENVLTQSPGTLSLSPGERATLSCR ASQRVSSSYLVWYQQKPGQAPR LLIYGASSRATGIPDRFSGSGSGT DFTLTISRLEPEDFAVYYCQQYGS SPYTFGQGTKLEIK |
| Antibody 10 | 190 | EVQLVESGGGLVKPGGS LRLSCAASGFTFSNAWM TWVRQAPGKGLEWVGR IKSKIDAGTTDYAAPVKG RFTISRDDSKNTLYLQM NSLKTEDTAVYYCTTDL GWGENYWGQGTLVTVS S | 200 | ENVLTQSPGTLSLSPGERATLSCR ASQRVSSSYLVWYQQKPGQAPR LLIYGASSRATGIPDRFSGSGSGT DFTLTISRLEPEDFAVYYCQQYGS SPYTFGQGTKLEIK |

TABLE 2.2

SEQUENCES OF HEAVY CHAIN VARIABLE REGIONS (VH) AND LIGHT CHAIN VARIABLE REGIONS (VL) OF TL1A BINDING PROTEINS (ANTIBODY 1-4, 11-119)

| Antibody | SEQ ID NO | VH | SEQ ID NO | VL |
|---|---|---|---|---|
| Antibody 1 | 181 | QVKLVESGGGVVQPGRS LRLSCAASGFTFSSYAM HWVRQAPGKGLEWVAV VSYEGSQNYYADSVKGR FTISRDNSKNTLYLQMNS LRAEDTAVYYCANLESA YYFDYWGQGTLVTVSS | 191 | DIVMTQSPLSLPVTPGEPASISCRS SQSLLYSNGYNSLDWYLQKTGQ SPQLLIYLGSNRASGVPDRFSGSG SGTDFTLKISRVEAEDVGVYYCM QALQTPYTFGQGTKLEIK |
| Antibody 2 | 182 | QVQLQESGPGLVKPSETL SLTCTVSGGSISSYYWSW IRQPPGKGLEWIGLIYYS GSTNYNPSLKSRVTISVD TSKNQFSLKLSSVTAADT AVYYCARADVVTIDYW GQGTLVTVSS | 192 | DIQMTQSPSSLSASVGDRVTITCR ASQTISSYFNWYQQKAGEAPKLL IYAASSLQSGVPSRFSGSGSGTDF TLTISSLQPEDFATYYCQQSYSTPI TFGQGTRLEIK |
| Antibody 3 | 183 | EVQLVESGGGLVKPGGS LRLSCAASGFTFSTYNM NWVRQAPGKGLEWISSI HSSSNYLYYADSVKGRF TISRDNAKNSLYLQMNS LRAEDTAVYYCATDRA MVDFDYWGQGTLVTVS S | 193 | DIQMTQSPSSLSASVGDRVTITCR ASQSISTYLNWYQQKPGKAPKLL IYAASSLQSGVPSRFSGSGSGTDF TLTISSLQPEDFAAYYCQQSYSTP LTFGGGTRVEIK |

TABLE 2.2-continued

SEQUENCES OF HEAVY CHAIN VARIABLE REGIONS (VH) AND LIGHT CHAIN VARIABLE REGIONS (VL) OF TL1A BINDING PROTEINS (ANTIBODY 1-4, 11-119)

| Antibody | SEQ ID NO | VH | SEQ ID NO | VL |
|---|---|---|---|---|
| Antibody 4 | 184 | QVQLQQSGPGLVKPSQT LSLTCAISGDSVSSNSAT WNWIRQSPSRGLEWLGR TYYRSKWYNDYAVSVK SRLTINPDTSKNQFSLQL NSVTPEDTAVYYCAREA VGPTKDFDYWGQGTLVP VSS | 194 | DIQMTQSPSSLSASVGDRVTITCR ASQSFSSYLNWYQQTPGKAPKLL IYAASSLQSGVPSRFSGSGSGTYF TLTISSLQPEDLATYYCQQSYFTP RTFGQGTKVEIK |
| Antibody 11 | 2275 | EVQLVQSGAEVKKPGAS VKVSCKASGYTFTGYYM HWVRQAPGQGLEWMG WINPKSGGTIYAQKFQG RVTMTRDTSISTAYMELS RLRSDDTAVYSCATGGS FDAFDIWGQGTMVTVSS | 2384 | DIQMTQSPSSLSASVGDRVTITCR ASQSISRYLYWYQQKPGKAPKLL IYGASSLQSGVPSRFSGSGSGTDF TLTVSSMQPEDFATYYCQQGFSA PLTFGGGTKVDIK |
| Antibody 12 | 2276 | QVQLQQWGAGLLKPSET LSLTCAVYGGSFSGYYW SWIRQPPGKGLEWIGEIT HSGITNYNPSLESRVTMS VDTSKNQFSLKLSSVTA ADTAVYYCARGQVGTT DYYYFYMDVWGKGTLV TVSS | 2385 | DIQMTQSPSSLSASVGDRVTITCR ASQSIRRYLNWYQQKPGKAPKLL IYAASSLQSGVPSRFSGSGSGTDF TLTISSLQPEDFASYFCQQSYRTIT FGQGTKLEIK |
| Antibody 13 | 2277 | QVQLVQSGAEVKKPGAS VKVSCKASGYTFTGYYM HWVRQAPGQGLEWMG WINPNSGGTNYAQNFQG RVTMTRDTSISTAYMELS RLRSDDTAVYYCAVGGS FDAFDIWGQGTMVTVSS | 2386 | DIQLTQSPSSLSASVGDRVTITCR ASQSISRYLNWYQQKPGKAPKILI YGASSVQSGVPSRFSGSGSGTDF TLAISSLQPEDFATYYCQQGDSSP FTFGPGTKVDIK |
| Antibody 14 | 2278 | QVQLVQSGAEVKKPGAS VKVSCKASGYTFTGYYM HWVRQAPGQGLEWMG WINPKSGGTNYAQNFQG RVTMTRDTSISTAYMELS RLRSDDTAVYYCAVGGS FDAFDIWGQGTMVTVSS | 2387 | DIQLTQSPSSLSASVGDRVTITCR ASQSISRYLNWYQQKPGKAPKILI YGASSVQSGVPSRFSGSGSGTDF TLAISSLQPEDFATYYCQQGDSSP FTFGPGTKVDIK |
| Antibody 15 | 2279 | QVQLVQSGPEVEKPGAS VKVSCKASGYTFTGYYM HWMRQAPGQGLEWMG WINPNSGGTNYAQKFQG RVTMTRDTSISTAYMDL SGLRSDDTAVYYCAVGG SFDAFDIWGQGTMVTVS S | 2388 | DIVMTQSPSSLSASVGDRVTITCR ASQSISSYLNWYQQKPGKAPKFL IYGASSLQSGVPSRFSGSGSGTDF TLTISSLQPEDFATYYCQQGHSTP FTFGPGTKVEIK |
| Antibody 16 | 2280 | QVQLVQSGAEVKKPGAS VKVSCKASGYTFTAYYM HWVRQAPGQGLEWIGW INPNSGGTNYAQSFQGR VTMTRDTSITTAYMDLS RLRSDDTAIYYCATGGSF DAFDIWGQGTMVTVSS | 2389 | DIVMTQSPSSLSASVGDRVTITCR ASQSISRYLNWYQQKPGKAPKILI YGASSVQSGVPSRFSGSGSGTDF TLAISSLQPEDFATYYCQQGDSSP FTFGPGTKVEIK |
| Antibody 17 | 2281 | QVQLVQSGAEVKKPGAS VKVSCKASGYTFTAYYM HWVRQAPGQGLEWIGW INPKSGGTNYAQSFQGR VTMTRDTSITTAYMDLS RLRSDDTAIYYCATGGSF DAFDIWGQGTMVTVSS | 2390 | DIVMTQSPSSLSASVGDRVTITCR ASQSISRYLNWYQQKPGKAPKILI YGASSVQSGVPSRFSGSGSGTDF TLAISSLQPEDFATYYCQQGDSSP FTFGPGTKVEIK |

TABLE 2.2-continued

SEQUENCES OF HEAVY CHAIN VARIABLE REGIONS (VH) AND LIGHT CHAIN VARIABLE REGIONS (VL) OF TL1A BINDING PROTEINS (ANTIBODY 1-4, 11-119)

| Antibody | SEQ ID NO | VH | SEQ ID NO | VL |
|---|---|---|---|---|
| Antibody 18 | 2282 | QVQLVQSGAEVKEPGAS VKVSCKASGYTFTAYYM HWVRQAPGQGLEWMG WINPNSGGTNYAQQFQG RVTMTRDTSISTAYMELS RLTSDDTAVYYCAVGGS YDAFDIWGQGTMVTVSS | 2391 | DIQMTQSPSSLSASVGDRVTITCR ASQSISSYLNWYQQKPGKAPKFL IYGASRLQSGVPSRFSGSGSGTDF TLSISSLQPEDFATYYCQQGHSTP FTFGPGTKLEIK |
| Antibody 19 | 2283 | QVQLVQSGAEVKEPGAS VKVSCKASGYTFTAYYM HWVRQAPGQGLEWMG WINPKSGGTNYAQQFQG RVTMTRDTSISTAYMELS RLTSDDTAVYYCAVGGS YDAFDIWGQGTMVTVSS | 2392 | DIQMTQSPSSLSASVGDRVTITCR ASQSISSYLNWYQQKPGKAPKFL IYGASRLQSGVPSRFSGSGSGTDF TLSISSLQPEDFATYYCQQGHSTP FTFGPGTKLEIK |
| Antibody 20 | 2284 | EVQLVQSGVEVKKPGAS VKVSCQASGYTFTAYYI HWVRQAPGQGLEWMG WINPNSGGTNYAQKFQG RVTMTRDSSISTAYMELS RLRSDDTAVYYCAVGGS FDAFDIWGQGTMVTVSS | 2393 | DIQMTQSPSSLSASVGDRVTITCR ASQSISSYLNWYQQKPGKAPKILI YGASSLQSGVPSRFSGSGSGTDFT LAISSLQPEDFATYYCQQGDSTPF TFGPGTKVDIK |
| Antibody 21 | 2285 | EVQLVQSGVEVKKPGAS VKVSCQASGYTFTAYYI HWVRQAPGQGLEWMG WINPKSGGTNYAQKFQG RVTMTRDSSISTAYMELS RLRSDDTAVYYCAVGGS FDAFDIWGQGTMVTVSS | 2394 | DIQMTQSPSSLSASVGDRVTITCR ASQSISSYLNWYQQKPGKAPKILI YGASSLQSGVPSRFSGSGSGTDFT LAISSLQPEDFATYYCQQGDSTPF TFGPGTKVDIK |
| Antibody 22 | 2286 | EVQLVQSGAEVKKPGAS VKVSCKASGYTFTGYYL HWVRQAPGQGLEWMG WINPNSGGTNFAQKFQG RVTMTRDTSINTAYMEL SRLRSDDTAVYYCAVGG SYDAFDIWGQGTMVTVS S | 2395 | DIQMTQSPSSLSASVGDRVTITCR ASQSISSYLNWYQQKPGKVPKILI YGASRLQSGVPSRFSGSGSGTDF TLAISSLQPEDFATYYCQQGDSTP FTFGPGTKVDIK |
| Antibody 23 | 2287 | EVQLVQSGAEVKKPGAS VKVSCKASGYTFTGYYL HWVRQAPGQGLEWMG WINPKSGGTNFAQKFQG RVTMTRDTSINTAYMEL SRLRSDDTAVYYCAVGG SYDAFDIWGQGTMVTVS S | 2396 | DIQMTQSPSSLSASVGDRVTITCR ASQSISSYLNWYQQKPGKVPKILI YGASRLQSGVPSRFSGSGSGTDF TLAISSLQPEDFATYYCQQGDSTP FTFGPGTKVDIK |
| Antibody 24 | 2288 | EVQLVQSGAEVKKPGAS VKVSCKASGYTFTGYYM HWVRQAPGQGLEWMG WINPNSGGTNYAQKFQG RVTMTRDTSISTAYMELS GLRSDDTAVYYCAVGGS YDAFDIWGQGTMVTVSS | 2397 | DIVMTQSPSSLSASVGDRVTITCR ASQSISSYLNWYQEKPGKAPKILI YGASRLQSGVPSRFSGSGSGTDF TLAISSLQPEDFATYYCQQGDSTP FTFGPGTKVEIK |
| Antibody 25 | 2289 | EVQLVQSGAEVKKPGAS VKVSCKASGYTFTGYYM HWVRQAPGQGLEWMG WINPKSGGTNYAQKFQG RVTMTRDTSISTAYMELS GLRSDDTAVYYCAVGGS YDAFDIWGQGTMVTVSS | 2398 | DIVMTQSPSSLSASVGDRVTITCR ASQSISSYLNWYQEKPGKAPKILI YGASRLQSGVPSRFSGSGSGTDF TLAISSLQPEDFATYYCQQGDSTP FTFGPGTKVEIK |

TABLE 2.2-continued

SEQUENCES OF HEAVY CHAIN VARIABLE REGIONS (VH) AND LIGHT CHAIN VARIABLE REGIONS (VL) OF TL1A BINDING PROTEINS (ANTIBODY 1-4, 11-119)

| Antibody | SEQ ID NO | VH | SEQ ID NO | VL |
|---|---|---|---|---|
| Antibody 26 | 2290 | QVQLVQSGAEVKKPGASVKFSCKASGYTFTGYYLHWVRQAPGQGLEWMGWINPNSGGTNYAQRFQGRVTMTRDTSINTAYMELSRLRSDDTAVYYCATGGSFDAFDIWGQGTMVTVSS | 2399 | DIQMTQSPSSLSASVGDRVTITCRASQSISSYLNWYQQSPGKAPKILIYGASRLQSGVPSRFSGSGSGTDFTLAISSLQPEDFATYYCQQGDSSPFTFGPGTKVEIK |
| Antibody 27 | 2291 | QVQLVQSGAEVKKPGASVKFSCKASGYTFTGYYLHWVRQAPGQGLEWMGWINPKSGGTNYAQRFQGRVTMTRDTSINTAYMELSRLRSDDTAVYYCATGGSFDAFDIWGQGTMVTVSS | 2400 | DIQMTQSPSSLSASVGDRVTITCRASQSISSYLNWYQQSPGKAPKILIYGASRLQSGVPSRFSGSGSGTDFTLAISSLQPEDFATYYCQQGDSSPFTFGPGTKVEIK |
| Antibody 28 | 2292 | EVQLVQSGAEVKKPGASVKVSCKASGYTFTGYYMHWVRQAPGQGLEWMGWINPKSGGTIYAQKFQGRVTMTRDTSISTAYMELSRLRSDDTAVYSCATGGSFDAFDIWGQGTMVTVSS | 2401 | DIVLTQSPSSLSASVGDRVTITCRASQSISSYLNWYQQKPGKAPKFLIYGASSLQSGVPSRFSGSGSGTDFTLTISSLQPEDFATYYCQQGHSTPFTFGPGTKVDIK |
| Antibody 29 | 2293 | EVQLVESGAEVKKPGASVKVSCKASGYTFTGYYMHWVRQAPGQGLEWMGWINPKSGGTNYAQKFQGRVTMTRDTSISTAYMELSRLRSDDTAVYYCATGGSFDAFDIWGQGTMVTVSS | 2402 | DIQMTQSPSSLSASVGDRVTITCRASQSISSYLNWYQQKPGKAPKILIYGASSLQSGVPSRFSGSGSGTDFTLAISSLQPEDFATYYCQQGDSTPFTFGPGTKLEIK |
| Antibody 30 | 2294 | EVQLVQSGAEVKKPGASVKVSCKASGYTFTGYYMHWVRQAPGQGLEWMGWINPKSGGTSYAQKFQGRVTMTRDTSISTAYMELSRLRSDDTAVYYCAVGGSYDAFDIWGQGTMVTVSS | 2403 | DIQMTQSPSSLSASVGDRVTITCRASQSISSYLNWYQQKPGKAPKFLIYGASSLQSGVPSRFSGSGSGTDFTLTISSLQPEDFATYYCQQGHSTPFTFGPGTKLEIK |
| Antibody 31 | 2295 | EVQLVESGAEVKKPGASVKVSCKASGYTFTGYYMHWVRQAPGQGLEWMGWINPKSGGTNYAQKFQGRVTMTRDTSISTAYMELSRLRSDDTAVYYCAVGGSYDAFDIWGQGTMVTVSS | 2404 | DIQMTQSPSSLSASVGDRVTITCRASQSISSYLNWYQQKPGKAPKFLIYGASRLQSGVPSRFSGSGSGTDFTLTISSLQPEDFATYYCQQGYSSPFTFGPGTKVEIK |
| Antibody 32 | 2296 | EVQLVQSGAEVRKPGASVKVSCKASGYTFTAYYIHWVRQAPGQGLEWMGWINPNSGGTNYAQNFQGRVTMTRDTSISTAYMELSRLRPDDTAVYFCAVGGSFDAFDIWGQGTMVTVSS | 2405 | DIQLTQSPSSLSASVGDRVTITCQASQDISNYLNWYQQKPGKAPKILIYGASSLQSGVPSRFSGSGSGTDFTLAISSLQPEDYATYYCQQGDSTPFTFGPGTKVEIK |
| Antibody 33 | 2297 | EVQLVQSGAEVRKPGASVKVSCKASGYTFTAYYIHWVRQAPGQGLEWMGWINPKSGGTNYAQNFQGRVTMTRDTSISTAYMELSRLRPDDTAVYFCAVGGSFDAFDIWGQGTMVTVSS | 2406 | DIQLTQSPSSLSASVGDRVTITCQASQDISNYLNWYQQKPGKAPKILIYGASSLQSGVPSRFSGSGSGTDFTLAISSLQPEDYATYYCQQGDSTPFTFGPGTKVEIK |
| Antibody 34 | 2298 | QVQLVQSGAEVKRPGAAVKVSCKASGYTFTGYYMHWVRQAPGQGLEWMGWINPKSGGTNYAQNFQGRVTMTRDTSISTAYMELSRLTSDDTAMYYCATGGSFDAFDIWGQGTMVTVSS | 2407 | DIQMTQSPSSVSASVGDRVTITCRASQGISRYLHWYQQKPGKAPNFLIYGASSLQSGVPSRFSGSGSGTDFTLTISSLQPEDFATYYCQQGFSTPFTFGPGTKLEIK |

TABLE 2.2-continued

SEQUENCES OF HEAVY CHAIN VARIABLE REGIONS (VH) AND LIGHT CHAIN VARIABLE REGIONS (VL) OF TL1A BINDING PROTEINS (ANTIBODY 1-4, 11-119)

| Antibody | SEQ ID NO | VH | SEQ ID NO | VL |
|---|---|---|---|---|
| Antibody 35 | 2299 | EVQLVQSGAEVKKPGAS VKVSCKASGYTFTGYYM HWVRQAPGQGLEWMG WINPNSGGTNYAQKFQG RVTMTRDTSISTAYMELS RLRSDDTAVYYCAVGGS YDAFDIWGQGTMVTVSS | 2408 | DIQMTQSPSSLSASVGDRVTITCR ASQSISSYLNWYQQKPGKAPKFL IYGASRLQSGVPSRFSGSGSGTDF TLTISSLQPEDFATYHCQQGSSPP FTFGPGTKLEIK |
| Antibody 36 | 2300 | EVQLVQSGAEVKKPGAS VKVSCKASGYTFTGYYM HWVRQAPGQGLEWMG WINPKSGGTNYAQKFQG RVTMTRDTSISTAYMELS RLRSDDTAVYYCAVGGS YDAFDIWGQGTMVTVSS | 2409 | DIQMTQSPSSLSASVGDRVTITCR ASQSISSYLNWYQQKPGKAPKFL IYGASRLQSGVPSRFSGSGSGTDF TLTISSLQPEDFATYHCQQGSSPP FTFGPGTKLEIK |
| Antibody 37 | 2301 | EVQLVQSGAEVKSPGAS VKVSCKASGYTFTAYYM HWVRQAPGQGLEWMG WINPNSGGTKYAQKFQG RVTVTRDTSISTAYMELN RLTSDDTAVYYCAVGGS YDAFDIWGQGTMVTVSS | 2410 | DIVMTQSPSSLSASVGDRVTITCR ASQSISSYLNWYQQKPGKAPNFL IYGASRLQSGVPSRFSGSGSGTDF TLTISSLQPEDFATYYCQQGYSSP FTFGPGTKVDIK |
| Antibody 38 | 2302 | EVQLVQSGAEVKSPGAS VKVSCKASGYTFTAYYM HWVRQAPGQGLEWMG WINPKSGGTKYAQKFQG RVTVTRDTSISTAYMELN RLTSDDTAVYYCAVGGS YDAFDIWGQGTMVTVSS | 2411 | DIVMTQSPSSLSASVGDRVTITCR ASQSISSYLNWYQQKPGKAPNFL IYGASRLQSGVPSRFSGSGSGTDF TLTISSLQPEDFATYYCQQGYSSP FTFGPGTKVDIK |
| Antibody 39 | 2303 | EVQLVQSGAEVKKPGAS VKVSCKASGYTFTAYYL HWVRQAPGQGLEWMG WINPNSGGTNYAQKFQG RVTMTRDTSISTAYMELS RLRSDDTAVYYCASGGS FDAFDIWGQGTMVTVSS | 2412 | DIQMTQSPSSLSASVGDRVTITCR ASQSISRYLNWYQQKPGKAPKILI YGASSVQSGVPSRFSGSGSGTDF TLAISSLQPEDFATYYCQQGDSSP FTFGPGTKLEIK |
| Antibody 40 | 2304 | EVQLVQSGAEVKKPGAS VKVSCKASGYTFTAYYL HWVRQAPGQGLEWMG WINPKSGGTNYAQKFQG RVTMTRDTSISTAYMELS RLRSDDTAVYYCASGGS FDAFDIWGQGTMVTVSS | 2413 | DIQMTQSPSSLSASVGDRVTITCR ASQSISRYLNWYQQKPGKAPKILI YGASSVQSGVPSRFSGSGSGTDF TLAISSLQPEDFATYYCQQGDSSP FTFGPGTKLEIK |
| Antibody 41 | 2305 | QVQLVESGAEVKKPGAS VKVSCKASGYTFTGYFIH WVRQAPGQGLEWMGWI NPKSGGTNYAQKFQDRV TMTRDTSISTAYMELSRL RSDDTAVYYCAVGGSY DAFDIWGQGTMVTVSS | 2414 | DIVLTQSPSSLSASVGDRVTITCR ASQSISSYLNWYQQKPGKAPKFL IYGASRLQSGVPSRFSGSGSGTDF TLTISSLQPEDFVTYYCQQGHSTP FTFGPGTKVDIK |
| Antibody 42 | 2306 | QVQLVQSGAEVKSPGAS VKVSCKASGYTFTAYYM HWVRQAPGQGLEWMG WINPNSGGTKYAQKFQG RVTVTRDTSISTAYMELN RLTSDDTAVYYCAVGGS YDAFDIWGQGTMVTVSS | 2415 | DIQMTQSPSSLSASVGDRVTITCR ASQSISSYLNWYQQSPGKAPKILI YGASRLQSGVPSRFSGSGSGTDF TLAISSLQPEDFATYYCQQGDSTP FTFGPGTKVEIK |
| Antibody 43 | 2307 | QVQLVQSGAEVKSPGAS VKVSCKASGYTFTAYYM HWVRQAPGQGLEWMG WINPKSGGTKYAQKFQG RVTVTRDTSISTAYMELN RLTSDDTAVYYCAVGGS YDAFDIWGQGTMVTVSS | 2416 | DIQMTQSPSSLSASVGDRVTITCR ASQSISSYLNWYQQSPGKAPKILI YGASRLQSGVPSRFSGSGSGTDF TLAISSLQPEDFATYYCQQGDSTP FTFGPGTKVEIK |

TABLE 2.2-continued

SEQUENCES OF HEAVY CHAIN VARIABLE REGIONS (VH) AND LIGHT CHAIN VARIABLE REGIONS (VL) OF TL1A BINDING PROTEINS (ANTIBODY 1-4, 11-119)

| Antibody | SEQ ID NO | VH | SEQ ID NO | VL |
|---|---|---|---|---|
| Antibody 44 | 2308 | QVQLVQSGAEVKKPGASVRVSCKASGYTFTAYYIHWVRQAPGQGLEWMGWINPNSGGTSSAQKFQGRVTMTRDTSISTAYMDLSRLRSDDTAVYYCAVGGSFDAFDIWGQGTMVTVSS | 2417 | DIVMTQSPSSLSASVGDRVTITCRASQSISSYLNWYQQKPGKAPKFLIYGASRLQSGVPSRFSGSGSGTDFTLTISSLQPEDFATYSCQQGYSSPFTFGPGTKVDIK |
| Antibody 45 | 2309 | QVQLVQSGAEVKKPGASVRVSCKASGYTFTAYYIHWVRQAPGQGLEWMGWINPKSGGTSSAQKFQGRVTMTRDTSISTAYMDLSRLRSDDTAVYYCAVGGSFDAFDIWGQGTMVTVSS | 2418 | DIVMTQSPSSLSASVGDRVTITCRASQSISSYLNWYQQKPGKAPKFLIYGASRLQSGVPSRFSGSGSGTDFTLTISSLQPEDFATYSCQQGYSSPFTFGPGTKVDIK |
| Antibody 46 | 2310 | EVQLVQSGAEVKKPGASVKVSCKASGYTFTAYYIHWVRQAPGQGLEWMGWVNPNSGGTNYAQSFQGRVTMTGDTSITTAYMDLSELRSDDTAVYYCAVGGSFDAFDIWGQGTMVTVSS | 2419 | DIVMTQSPSSLSASVGDRVTITCRASQSISSYLNWYQQKPGKAPKFLIYGASSLQSGVPSRFSGSGSGTDFTLTISSLQPEDFATYYCQQGHSTPFTFGPGTKVDIK |
| Antibody 47 | 2311 | EVQLVQSGAEVKKPGASVKVSCKASGYTFTAYYIHWVRQAPGQGLEWMGWVNPKSGGTNYAQSFQGRVTMTGDTSITTAYMDLSELRSDDTAVYYCAVGGSFDAFDIWGQGTMVTVSS | 2420 | DIVMTQSPSSLSASVGDRVTITCRASQSISSYLNWYQQKPGKAPKFLIYGASSLQSGVPSRFSGSGSGTDFTLTISSLQPEDFATYYCQQGHSTPFTFGPGTKVDIK |
| Antibody 48 | 2312 | QVQLVQSGAEVKSPGASVKVSCKASGYTFTAYYMHWVRQAPGQGLEWMGWINPNSGGTKYAQKFQGRVTVTRDTSISTAYMELNRLTSDDTAVYYCATGGSFDAFDIWGQGTMVTVSS | 2421 | DIQMTQSPSSLSASVGDRVTITCRASQSISSYLNWYQQKPGKAPKILIYGASSLQSGVPSRFSGSGSGTDFTLAISSLQPEDFATYYCQQGDSTPFTFGPGTKVDIK |
| Antibody 49 | 2313 | QVQLVQSGAEVKSPGASVKVSCKASGYTFTAYYMHWVRQAPGQGLEWMGWINPKSGGTKYAQKFQGRVTVTRDTSISTAYMELNRLTSDDTAVYYCATGGSFDAFDIWGQGTMVTVSS | 2422 | DIQMTQSPSSLSASVGDRVTITCRASQSISSYLNWYQQKPGKAPKILIYGASSLQSGVPSRFSGSGSGTDFTLAISSLQPEDFATYYCQQGDSTPFTFGPGTKVDIK |
| Antibody 50 | 2314 | EVQLVQSGAEVKKPGASVKVSCKASGYTFTGYYIHWVRQAPGQGLEWMGWINPKSGGTNYAQKFQGRVTMTRDTSISTAYMELSRLRSDDTAVYYCAVGGSYDAFDIWGQGTMVTVSS | 2423 | DIVLTQSPSSLSASVGDRVTITCRASQSISSYLNWYQQKPGKAPKILIYGASSLQSGVPSRFSGSGSGTDFTLAISSLQPEDFATYYCQQGDSTPFTFGPGTKVDIK |
| Antibody 51 | 2315 | EVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAVGGSYDAFDIWGQGTMVTVSS | 2424 | DIVLTQSPSSLSASVGDRVTITCRASQSISSYLNWYQQKPGKAPKILIYGASSLQSGVPSRFSGSGSGTDFTLAISSLQPEDFATYYCQQGDSTPFTFGPGTKVDIK |

TABLE 2.2-continued

SEQUENCES OF HEAVY CHAIN VARIABLE REGIONS (VH) AND LIGHT CHAIN VARIABLE REGIONS (VL) OF TL1A BINDING PROTEINS (ANTIBODY 1-4, 11-119)

| Antibody | SEQ ID NO | VH | SEQ ID NO | VL |
|---|---|---|---|---|
| Antibody 52 | 2316 | EVQLVQSGAEVKKPGAS VKVSCKASGYTFTGYYM HWVRQAPGQGLEWMG WINPKSGGTNYAQKFQG RVTMTRDTSISTAYMELS RLRSDDTAVYYCAVGGS YDAFDIWGQGTMVTVSS | 2425 | DIVLTQSPSSLSASVGDRVTITCR ASQSISSYLNWYQQKPGKAPKILI YGASSLQSGVPSRFSGSGSGTDFT LAISSLQPEDFATYYCQQGDSTPF TFGPGTKVDIK |
| Antibody 53 | 2317 | QVQLVQSGAEVKKPGAS VKVSCKASGYTFTGYYM HWVRQAPGQGLEWMG WIHPNSGGTNSAQKFQG RVTMTRDTSISTAYMELS RLRSDDTAVYYCAVGGS YDAFDIWGQGTMVTVSS | 2426 | DIVMTQSPSSLSASEGDRVTITCR ASQSISSYLNWYQQKPGKAPKFL IYGASRLQSGVPSRFSGSGSGTDF TLTISSLQPEDFATYYCQQGYSSP FTFGPGTKVEIK |
| Antibody 54 | 2318 | QVQLVQSGAEVKKPGAS VKVSCKASGYTFTGYYM HWVRQAPGQGLEWMG WIHPKSGGTNTAQKFQG RVTMTRDTSISTAYMELS RLRSDDTAVYYCAVGGS YDAFDIWGQGTMVTVSS | 2427 | DIVMTQSPSSLSASEGDRVTITCR ASQSISSYLNWYQQKPGKAPKFL IYGASRLQSGVPSRFSGSGSGTDF TLTISSLQPEDFATYYCQQGYSSP FTFGPGTKVEIK |
| Antibody 55 | 2319 | QVQLVQSGAEVKKPGAS VKVSCKASGYTFTGYFIH WVRQAPGQGLEWMGWI NPKSGGTNYAQKFQGRV TMTRDTSISTAYMELSRL SSDDTAVYYCASGGSFD AFDIWGQGTMVTVSS | 2428 | DIQMTQSPSSLSASVGDRVTITCR ASQSISRYLNWYQQKPGKAPKILI YGASSVQSGVPSRFSGSGSGTDF TLAISSLQPEDFATYYCQQGDSSP FTFGPGTKVEIK |
| Antibody 56 | 2320 | QVQLVQAGAEVKKPGA SVKVSCKASGYTFTGYY MHWVRQAPGQGLEWM GWINPNSGGTNYAQKFQ GRVTMTRDTSISTAYME LSRLRSDDTAVYYCATG GSFDAFDIWGQGTMVTV SS | 2429 | DIQMTQSPSSLSASVGDRVTITCR ASQSISSYLNWYQQKPGKAPKFL IYGASRLQSGVPSRFSGSGSGTDF TLTISSLQPEDFATYYCQQGYSSP FTFGPGTKVEIK |
| Antibody 57 | 2321 | QVQLVQAGAEVKKPGA SVKVSCKASGYTFTGYY MHWVRQAPGQGLEWM GWINPKSGGTNYAQKFQ GRVTMTRDTSISTAYME LSRLRSDDTAVYYCATG GSFDAFDIWGQGTMVTV SS | 2430 | DIQMTQSPSSLSASVGDRVTITCR ASQSISSYLNWYQQKPGKAPKFL IYGASRLQSGVPSRFSGSGSGTDF TLTISSLQPEDFATYYCQQGYSSP FTFGPGTKVEIK |
| Antibody 58 | 2322 | EVQLVQSGAEVKNPGAS VKVSCKASGYTFTGYYM HWVRQAPGQGLEWMG WINPNSGGPNYAQKFQD RVTMTRDTSISTAYMELS RLRSDDTAVYYCATGGS FDAFDIWGQGTMVTVSS | 2431 | DIVMTQSPSSLSASVGDRVTITCR ASQSISNYLNWYQQKPGKAPKFL IYGTSRLQSGVPSRFSGSGSGTDF TLTISSLQPEDFATYYCQQGYSSP FTFGPGTKVDIK |
| Antibody 59 | 2323 | EVQLVQSGAEVKNPGAS VKVSCKASGYTFTGYYM HWVRQAPGQGLEWMG WINPKSGGPNYAQKFQD RVTMTRDTSISTAYMELS RLRSDDTAVYYCATGGS FDAFDIWGQGTMVTVSS | 2432 | DIVMTQSPSSLSASVGDRVTITCR ASQSISNYLNWYQQKPGKAPKFL IYGTSRLQSGVPSRFSGSGSGTDF TLTISSLQPEDFATYYCQQGYSSP FTFGPGTKVDIK |

TABLE 2.2-continued

SEQUENCES OF HEAVY CHAIN VARIABLE REGIONS (VH) AND LIGHT CHAIN VARIABLE REGIONS (VL) OF TL1A BINDING PROTEINS (ANTIBODY 1-4, 11-119)

| Antibody | SEQ ID NO | VH | SEQ ID NO | VL |
|---|---|---|---|---|
| Antibody 60 | 2324 | EVQLVESGAEVKKPGASVKVSCKASGYTFTGYFMHWVRQAPGQGLEWMGWINPNSGGTNYAQRFQGRVTMTRDTSINTAYMELSRLRSDDTAVYYCATGGSFDAFDIWGQGTMVTVSS | 2433 | DIVMTQSPSSLSASVGDRVTITCRASQSISSYLNWYQQKPGKAPKFLIYGASRLQSGVPSRFSGSGSGTDFTLTISSLQPEDFATYYCQQGYSSPFTFGPGTKVDIK |
| Antibody 61 | 2325 | EVQLVESGAEVKKPGASVKVSCKASGYTFTGYFMHWVRQAPGQGLEWMGWINPKSGGTNYAQRFQGRVTMTRDTSINTAYMELSRLRSDDTAVYYCATGGSFDAFDIWGQGTMVTVSS | 2434 | DIVMTQSPSSLSASVGDRVTITCRASQSISSYLNWYQQKPGKAPKFLIYGASRLQSGVPSRFSGSGSGTDFTLTISSLQPEDFATYYCQQGYSSPFTFGPGTKVDIK |
| Antibody 62 | 2326 | EVQLVQSGAEVKKPGASVNVSCKASGYTFTGYYMHWVRQAPGQGLEWMGWINPNSGGTNYAQKFQGRVTMTRDTSISTAYMELSRLISDDTAVYYCATGGSFDAFDVWGQGTMVTVSS | 2435 | DIVMTQSPSSLSASVGDRVTITCRASQSISSYLNWYQQSPGKAPKILIYGASRLQSGVPSRFSGSGSGTDFTLAISSLQPEDFATYYCQQGDNTPFTFGPGTKLEIK |
| Antibody 63 | 2327 | EVQLVQSGAEVKKPGASVKVSCKASGYTFTGYYMHWVRQAPGQGLEWMGWINPKSGGTNYAQKFQGRVTMTRDTSISTAYMELSRLISDDTAVYYCATGGSFDAFDVWGQGTMVTVSS | 2436 | DIVMTQSPSSLSASVGDRVTITCRASQSISSYLNWYQQSPGKAPKILIYGASRLQSGVPSRFSGSGSGTDFTLAISSLQPEDFATYYCQQGDNTPFTFGPGTKLEIK |
| Antibody 64 | 2328 | QVQLVQSGAEVKKPGASVKVSCKASGYTFTGYYMQWVRQAPGQGLEWMGWINPNSGGTIYAQKFQGRVTMTRDTSISTAYMELSRLRSDDTAVYSCATGGSFDAFDIWGQGTMVTVSS | 2437 | DIVLTQSPSSLSASVGDRVTITCRASQSISSYLNWYQQKPGKAPKFLIYGASRLQSGVPSRFSGSGSGTDFTLTISSLQPEDFATYYCQQGHSTPFTFGPGTKVDIK |
| Antibody 65 | 2329 | QVQLVQSGAEVKKPGASVKVSCKASGYTFTGYYMQWVRQAPGQGLEWMGWINPKSGGTIYAQKFQGRVTMTRDTSISTAYMELSRLRSDDTAVYSCATGGSFDAFDIWGQGTMVTVSS | 2438 | DIVLTQSPSSLSASVGDRVTITCRASQSISSYLNWYQQKPGKAPKFLIYGASRLQSGVPSRFSGSGSGTDFTLTISSLQPEDFATYYCQQGHSTPFTFGPGTKVDIK |
| Antibody 66 | 2330 | EVQLVESGAEVKNPGASVKVSCKASGYTFTGYYLHWVRQAPGQGLEWMGWIKPNSGGTNYAQKFQGRVTMTRDTSISTAYMELSRLRSDDTAVYYCAVGGSYDAFDIWGQGTMVTVSS | 2439 | DIVMTQSPSSLSASVGDRVTITCRASQSISSYLNWYQQQPGKAPKFLIYGASRLQSGVPSRFSGSGSGTDFTLTINSLQPEDFATYFCQQGYSSPFTFGPGTKVEIK |
| Antibody 67 | 2331 | EVQLVESGAEVKNPGASVKVSCKASGYTFTGYYLHWVRQAPGQGLEWMGWIKPKSGGTNYAQKFQGRVTMTRDTSISTAYMELSRLRSDDTAVYYCAVGGSYDAFDIWGQGTMVTVSS | 2440 | DIVMTQSPSSLSASVGDRVTITCRASQSISSYLNWYQQQPGKAPKFLIYGASRLQSGVPSRFSGSGSGTDFTLTINSLQPEDFATYFCQQGYSSPFTFGPGTKVEIK |

TABLE 2.2-continued

SEQUENCES OF HEAVY CHAIN VARIABLE REGIONS (VH) AND LIGHT CHAIN VARIABLE REGIONS (VL) OF TL1A BINDING PROTEINS (ANTIBODY 1-4, 11-119)

| Antibody | SEQ ID NO | VH | SEQ ID NO | VL |
|---|---|---|---|---|
| Antibody 68 | 2332 | QVQLVQSGAEVKKPGASVKVSCKASGYTFTAYYMHWVRQAPGQGLEWMGWVNPNSGGTNYAQNFQGRVTMTGDTSITTAYMDLSGLRSDDTAVYYCAVGGSFDAFDIWGQGTMVTVSS | 2441 | DIVLTQSPASLSASVGDRVAITCRASQSISSYLNWYQQKPGKAPKFLIYGASSLQSGVPSRFSGSGSGTDFTLTISSLQPEDFATYYCQQGHSTPFTFGPGTKLEIK |
| Antibody 69 | 2333 | QVQLVQSGAEVKKPGASVKVSCKASGYTFTAYYMHWVRQAPGQGLEWMGWVNPKSGGTNYAQNFQGRVTMTGDTSITTAYMDLSGLRSDDTAVYYCAVGGSFDAFDIWGQGTMVTVSS | 2442 | DIVLTQSPASLSASVGDRVAITCRASQSISSYLNWYQQKPGKAPKFLIYGASSLQSGVPSRFSGSGSGTDFTLTISSLQPEDFATYYCQQGHSTPFTFGPGTKLEIK |
| Antibody 70 | 2334 | QVQLVQSGAEVKKPGASVKVSCKASGYTFTGYYMHWVRQAPGQGLEWMGWINPNSGGTNYAQKFQGRVTMTRDTSISTAYMELSRLISDDTAVYYCATGGSFDAFDIWGQGTMVTVSS | 2443 | DIVMTQSPSSLSASVGDRVTITCRASQTISSYLNWYQQKPGKAPKILIYGASSLQSGVPSRFSGSGSGTDFTLAISSLQPEDFATYYCQQGDSTPFTFGPGTKVDIK |
| Antibody 71 | 2335 | QVQLVQSGAEVKKPGASVKVSCKASGYTFTGYYMHWVRQAPGQGLEWMGWINPKSGGTNYAQKFQGRVTMTRDTSISTAYMELSRLISDDTAVYYCATGGSFDAFDIWGQGTMVTVSS | 2444 | DIVMTQSPSSLSASVGDRVTITCRASQTISSYLNWYQQKPGKAPKILIYGASSLQSGVPSRFSGSGSGTDFTLAISSLQPEDFATYYCQQGDSTPFTFGPGTKVDIK |
| Antibody 72 | 2336 | QVQLVQSGAEVKKPGASMKVSCKASGYTFTGYYMHWVRQAPGQGLEWMGWINPNSGGTNYAQRFQGRVTMTRDTSVSTAYMDLSRLRSDDTAVYYCATGGSFDAFDIWGQGTMVTVSS | 2445 | DIVLTQSPSSLSASVGDRVTITCRASQSISKYLIWYQQKPGKAPNLLIYGASSLQSGVPSRFSGSGSGTDFTLTISSLQPEDFATYYCQQGHSTPFTFGPGTKVDIK |
| Antibody 73 | 2337 | QVQLVQSGAEVKKPGASMKVSCKASGYTFTGYYMHWVRQAPGQGLEWMGWINPKSGGTNYAQRFQGRVTMTRDTSVSTAYMDLSRLRSDDTAVYYCATGGSFDAFDIWGQGTMVTVSS | 2446 | DIVLTQSPSSLSASVGDRVTITCRASQSISKYLIWYQQKPGKAPNLLIYGASSLQSGVPSRFSGSGSGTDFTLTISSLQPEDFATYYCQQGHSTPFTFGPGTKVDIK |
| Antibody 74 | 2338 | EVQLVESGAEVKKPGASVKVSCKASGYTFTGYYMHWVRQAPGQGLEWMGWIKPNSGGTNYAQKFQGRVTMTRDTSISTAYMELSRLRSDDTAVYYCAVGGSYDAFDIWGQGTMVTVSS | 2447 | DIQLTQSPSSLSASVGDRVTITCRASQSISSYLNWYQQSPGKAPKILIYGASRLQSGVPSRFSGSGSGTDFTLAISSLQPEDFATYYCQQGDSTPFTFGPGTKVDIK |
| Antibody 75 | 2339 | EVQLVESGAEVKKPGASVKVSCKASGYTFTGYYMHWVRQAPGQGLEWMGWIKPKSGGTNYAQKFQGRVTMTRDTSISTAYMELSRLRSDDTAVYYCAVGGSYDAFDIWGQGTMVTVSS | 2448 | DIQLTQSPSSLSASVGDRVTITCRASQSISSYLNWYQQSPGKAPKILIYGASRLQSGVPSRFSGSGSGTDFTLAISSLQPEDFATYYCQQGDSTPFTFGPGTKVDIK |
| Antibody 76 | 2340 | EVQLVESGAEVKKPGASVKVSCKASGYTFTGYYIHWVRQAPGQGLEWMGWINPNSGGTNYAQKFQGRVTMTRDTSISTAYMDL | 2449 | DIVMTQSPSSLSASVGDRVTITCRASQSISSYLNWYQQKPGKAPKFLIYGASRLQSGVPSRFSGSGSGTDFTLTISSLQPEDFATYYCQQGYSSPFTFGPGTKVDIK |

TABLE 2.2-continued

SEQUENCES OF HEAVY CHAIN VARIABLE REGIONS (VH) AND LIGHT CHAIN VARIABLE REGIONS (VL) OF TL1A BINDING PROTEINS (ANTIBODY 1-4, 11-119)

| Antibody | SEQ ID NO | VH | SEQ ID NO | VL |
|---|---|---|---|---|
| | | SRLRSDDTAVYYCATGG SFDAFDIWGQGTMVTVS S | | |
| Antibody 77 | 2341 | EVQLVESGAEVKKPGAS VKVSCKASGYTFTGYYI HWVRQAPGQGLEWMG WINPKSGGTNYAQKFQG RVTMTRDTSISTAYMDL SRLRSDDTAVYYCATGG SFDAFDIWGQGTMVTVS S | 2450 | DIVMTQSPSSLSASVGDRVTITCR ASQSISSYLNWYQQKPGKAPKFL IYGASRLQSGVPSRFSGSGSGTDF TLTISSLQPEDFATYYCQQGYSSP FTFGPGTKVDIK |
| Antibody 78 | 2342 | EVQLVQSGAEVKSPGAS VKVSCKASGYTFTAYYM HWVRQAPGQGLEWMG WINPNSGGTKYAQKFQG RVTVTRDTSISTAYMELN RLTSDDTAVYYCAVGGS YDAFDIWGQGTMVTVSS | 2451 | DIVLTQSPSSLSASVGDRVTITCR ASLSISSYLNWYQQKPGKAPKLLI YGASSLQSGVPSRFSGSGSGTDFT LTISSLQPEDFATYYCQQGHSTPF TFGPGTKLEIK |
| Antibody 79 | 2343 | EVQLVQSGAEVKSPGAS VKVSCKASGYTFTAYYM HWVRQAPGQGLEWMG WINPKSGGTKYAQKFQG RVTVTRDTSISTAYMELN RLTSDDTAVYYCAVGGS YDAFDIWGQGTMVTVSS | 2452 | DIVLTQSPSSLSASVGDRVTITCR ASLSISSYLNWYQQKPGKAPKLLI YGASSLQSGVPSRFSGSGSGTDFT LTISSLQPEDFATYYCQQGHSTPF TFGPGTKLEIK |
| Antibody 80 | 2344 | QVQLVQSGAEVKKPGAS VKVSCKASGYTFTGYYM HWVRQAPGQGLEWMG WINPNSGGTNYAQKFQG RVTMTRDTSISTAYMELS RLRSDDTAVYYCATGGS FDAFDIWGQGTMVTVSS | 2453 | DIQMTQSPSSLSASVGDRVTITCR ASQSISSYLNWYQQKPGKAPKILI YGASSLQSGVPSRFSGSGSGTDFT LAISSLQPEDFATYYCQQGDSTPF TFGPGTKVEIK |
| Antibody 81 | 2345 | EVQLVQSGAEVKKPGAP VKVSCKASGYTFTGYYM HWVRQAPGQGLEWMG WINPNSGGTNYAQKFQG RVTMTRDTSISTAYMELS RLRSDDTAVYYCAVGGS YDAFDIWGQGTMVTVSS | 2454 | DIQMTQSPSSLSASVGDRVTITCR SSQSISSYLNWYQQKPGKAPKILI YGASSLQSGVPSRFSGSGSGTDFT LAISSLQPEDFATYYCQQGDSTPF TFGPGTKVEIK |
| Antibody 82 | 2346 | EVQLVQSGAEVKKPGAP VKVSCKASGYTFTGYYM HWVRQAPGQGLEWMG WINPKSGGTNYAQKFQG RVTMTRDTSISTAYMELS RLRSDDTAVYYCAVGGS YDAFDIWGQGTMVTVSS | 2455 | DIQMTQSPSSLSASVGDRVTITCR SSQSISSYLNWYQQKPGKAPKILI YGASSLQSGVPSRFSGSGSGTDFT LAISSLQPEDFATYYCQQGDSTPF TFGPGTKVEIK |
| Antibody 83 | 2347 | EVQLVQSGAEVKKPGAS VKVSCKASGYTFTGYYM HWVRQAPGQGLEWMG WINPNSGATNFAQKFQG RVTMTRDTSITTAYMEL SRLRSDDTAVYYCATGG SFDAFDIWGQGTMVTVS S | 2456 | DIQMTQSPSSLSASVGDRVTITCR ASRSISSYLNWYQQRPGKAPKFLI YGASRLQTGVPSRFSGSGSGTDF TLTISSLQPEDFATYYCQQGYSSP FTFGPGTKVDIK |
| Antibody 84 | 2348 | EVQLVQSGAEVKKPGAS VKVSCKASGYTFTGYYM HWVRQAPGQGLEWMG WINPKSGATNFAQKFQG RVTMTRDTSITTAYMEL SRLRSDDTAVYYCATGG SFDAFDIWGQGTMVTVS S | 2457 | DIQMTQSPSSLSASVGDRVTITCR ASRSISSYLNWYQQRPGKAPKFLI YGASRLQTGVPSRFSGSGSGTDF TLTISSLQPEDFATYYCQQGYSSP FTFGPGTKVDIK |

TABLE 2.2-continued

SEQUENCES OF HEAVY CHAIN VARIABLE REGIONS (VH) AND LIGHT CHAIN VARIABLE REGIONS (VL) OF TL1A BINDING PROTEINS (ANTIBODY 1-4, 11-119)

| Antibody | SEQ ID NO | VH | SEQ ID NO | VL |
|---|---|---|---|---|
| Antibody 85 | 2349 | QVQLVQSGAEVKRPGASVKVSCKASGYTFTAYYLHWVRQAPGQGLEWMGWINPNSGGTNYAQKFQDRVTMTGDTSISTAYMELSRLRSDDTAVYYCAVGGSYDAFDIWGQGTMVTVSS | 2458 | DIQMTQSPSSLSASVGDRVTITCRASQSINSYLNWYQQKPGKAPKFLIYGASSLQSGVPSRFSGSGSGTDFTLTISSLQPEDFATYYCQQGYSTPFTFGPGTKVEIK |
| Antibody 86 | 2350 | QVQLVQSGAEVKRPGASVKVSCKASGYTFTAYYLHWVRQAPGQGLEWMGWINPKSGGTNYAQKFQDRVTMTGDTSISTAYMELSRLRSDDTAVYYCAVGGSYDAFDIWGQGTMVTVSS | 2459 | DIQMTQSPSSLSASVGDRVTITCRASQSIQSYLNWYQQKPGKAPKFLIYGASSLQSGVPSRFSGSGSGTDFTLTISSLQPEDFATYYCQQGYSTPFTFGPGTKVEIK |
| Antibody 87 | 2351 | QVQLVQSGAEVKSPGASVKVSCKASGYTFTAYYMHWVRQAPGQGLEWMGWINPNSGGTKYAQKFQGRVTVTRDTSISTAYMELNRLTSDDTAVYYCAVGGSYDAFDIWGQGTMVTVSS | 2460 | DIQMTQSPSTLSASVGDRVTITCRASQSISSYLNWYQQSPGKAPKILIYGASRLQSGVPSRFSGSGSGTDFTLAISSLQPEDFATYYCQQGDNTPFTFGPGTKVDIK |
| Antibody 88 | 2352 | QVQLVQSGAEVKSPGASVKVSCKASGYTFTAYYMHWVRQAPGQGLEWMGWINPKSGGTKYAQKFQGRVTVTRDTSISTAYMELNRLTSDDTAVYYCAVGGSYDAFDIWGQGTMVTVSS | 2461 | DIQMTQSPSTLSASVGDRVTITCRASQSISSYLNWYQQSPGKAPKILIYGASRLQSGVPSRFSGSGSGTDFTLAISSLQPEDFATYYCQQGDNTPFTFGPGTKVDIK |
| Antibody 89 | 2353 | QVQLVQSGAEVKKPGASVKVSCKASGYTFTGYYMHWVRQAPGQGLEWMGWINPKSGGTNYAQKFQGRVTMTRDTSISTAYMELSRLRSDDTAVYYCATGGSYDAFDIWGQGTMVTVSS | 2462 | DIQMTQSPSSLSASVGDRVTITCRASQSINSYLYWYQQKPGKAPKLLIYGASSLQSGVPSRFSGSGSGTDFTLTISSLQPEDSATYYCQQGYSTPFTFGPGTKVEIK |
| Antibody 90 | 2354 | QVQLVQSGAEVKKPGASVKVSCKASGYTFTGYYMHWVRQAPGQGLEWMGWINPKSGGTNYAQKFQGRVTMTRDTSISTAYMELSRLRSDDTAVYYCATGGSYDAFDIWGQGTMVTVSS | 2463 | DIQMTQSPSSLSASVGDRVTITCRASQSIQSYLYWYQQKPGKAPKLLIYGASSLQSGVPSRFSGSGSGTDFTLTISSLQPEDSATYYCQQGYSTPFTFGPGTKVEIK |
| Antibody 91 | 2355 | EVQLVQSGAEVKKPGASVKVSCKTSGYTFTAYYLHWVRQAPGQGLEWMGWINPNSGGTSSAQKFQGRVTMTRDTSISTAYMDLTRLRSDDTAVYYCAVGGSFDAFDIWGQGTMVTVSS | 2464 | DIQMTQSPSSLSASVGDRVTITCRASQSISSYLNWYQQKPGKAPKILIYGASSLQSGVPSRFSGSGSGTDFTLAISSLQPEDFATYYCQQGDSTPFTFGPGTKVDIK |
| Antibody 92 | 2356 | EVQLVQSGAEVKKPGASVKVSCKTSGYTFTAYYLHWVRQAPGQGLEWMGWINPKSGGTSSAQKFQGRVTMTRDTSISTAYMDLTRLRSDDTAVYYCAVGGSFDAFDIWGQGTMVTVSS | 2465 | DIQMTQSPSSLSASVGDRVTITCRASQSISSYLNWYQQKPGKAPKILIYGASSLQSGVPSRFSGSGSGTDFTLAISSLQPEDFATYYCQQGDSTPFTFGPGTKVDIK |

TABLE 2.2-continued

SEQUENCES OF HEAVY CHAIN VARIABLE REGIONS (VH) AND LIGHT CHAIN VARIABLE REGIONS (VL) OF TL1A BINDING PROTEINS (ANTIBODY 1-4, 11-119)

| Antibody | SEQ ID NO | VH | SEQ ID NO | VL |
|---|---|---|---|---|
| Antibody 93 | 2357 | QVQLVQSGAEVKKPGASVKVSCKASGYTFTGYYMHWVRQAPGQGLEWMGWINPNSGGTHYAQKFQGRVTMTRDTSISTAYMELSRLRSDDTAVYFCAVGGSFDAFDIWGQGTMVTVSS | 2466 | DIVMTQSPSSLSASVGDRVTITCRASLSISSYLNWYQQKPGKAPKLLIYGASSLQSGVPSRFSGSGSGTDFTLTISSLQPEDFATYYCQQGHSTPFTFGPGTKLEIK |
| Antibody 94 | 2358 | QVQLVQSGAEVKKPGASVKVSCKASGYTFTGYYMHWVRQAPGQGLEWMGWINPKSGGTHYAQKFQGRVTMTRDTSISTAYMELSRLRSDDTAVYFCAVGGSFDAFDIWGQGTMVTVSS | 2467 | DIVMTQSPSSLSASVGDRVTITCRASLSISSYLNWYQQKPGKAPKLLIYGASSLQSGVPSRFSGSGSGTDFTLTISSLQPEDFATYYCQQGHSTPFTFGPGTKLEIK |
| Antibody 95 | 2359 | EVQLVQSGAEVKKPGASVKVSCKASGYTFTGYYIHWVRQAPGQGLEWMGWINPNSGGTNYAQRFQGRVTMTRDTSISTAYMDLSRLRSDDTAVYYCATGGSFDAFDIWGQGTMVTVSS | 2468 | DIVMTQSPSSLSASVGDRVTITCRASQSISSYLNWYQQKPGKAPKFLIYGASRLQSGVPSRFSGSGSGTDFTLTISSLQPEDFATYFCQQGYSSPFTFGPGTKLEIK |
| Antibody 96 | 2360 | QVQLVQSGAEVKKPGASVKVSCKASGYTFTGYYMHWVRQAPGQGLEWMGWINPKSGGTIYAQKFQGRVTMTRDTSISTAYMELSRLRSDDTAVYSCATGGSFDAFDIWGQGTMVTVSS | 2469 | EIVMTQSPASLSASVGDRVTITCRASQTISRYLNWYQQKPGKAPKFLIYGASSLQSGVPSRFSGSGSGTDFTLTISSLQPEDFATYYCQQSYSTPFTFGPGTKVDIK |
| Antibody 97 | 2361 | QVQLVQSGAEVKRPGASLTVSCKSSGYTFTAYYIHWVRQAPGQGLEWMGWINPNSGGTNYAQKFQGRVTMTRDTSITTAYMELSRLRSDDTAVYYCAVGGSYDAFDIWGQGTMVTVSS | 2470 | EIVMTQSPASLSASVGDRVTITCRASQTISRYLNWYQQKPGKAPKFLIYGASSLQSGVPSRFSGSGSGTDFTLTISSLQPEDFATYYCQQGYSTPFTFGPGTKVDIK |
| Antibody 98 | 2362 | QVQLVQSGAEVKKPGASVKVSCKASGYTFTGYFMHWVRQAPGQGLEWMGWINPKSGGTNYAQKFQGRVTMTRDTSISTAYMELSRLRFDDTAVYYCASGGSFDAFDIWGQGTMVTVSS | 2471 | DIQMTQSPSSLSASVGDRVTITCRASQSISSYLNWYQQSPGKAPKILIYGASRLQSGVPSRFRGSGSGTDFTLAISSLQPEDFATYYCQQGDSTPFTFGPGTKVDIK |
| Antibody 99 | 2363 | EVQLVESGAEVKKPGASVKVSCKASGYTFTGYYMHWVRQAPGRGLEWMGWINPNSGGTKYAQKFQGRVTMTRDTSINTAYMELSRLRPDDTAVYYCATGGSFDAFDIWGQGTMVTVSS | 2472 | DIVLTQSPSSLSASVGDRVTITCRASQSISSYLNWYQQKPGKAPKFLIYGASRLQSGVPSRFSGSGSGTDFTLTISSLQPEDFATYFCQQGYSSPFTFGPGTKLEIK |
| Antibody 100 | 2364 | EVQLVESGAEVKKPGASVKVSCKASGYTFTGYYMHWVRQAPGQGLEWMGWINPNSGGTNYAQKFQGRVTMTRDTSISTAYMELSRLRSDDTAVYYCASGGSFDAFDIWGQGTMVTVSS | 2473 | DIQMTQSPSSLSASVGDRVTITCRASQSISRYLNWYQQKPGKAPKILIYGASSVQSGVPSRFSGSGSGTDFTLAISSLQPEDFATYYCQQGDSSPFTFGPGTKVDIK |
| Antibody 101 | 2365 | QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAVGGSYDAFDIWGQGTMVTVSS | 2474 | DIQMTQSPSSLSASVGDRVTITCRASQSISRYLNWYQQKPGKAPKILIYGASSLQSGVPSRFSGSGSGTDFTLTISSLQPEDFATYYCQQGYSTLFTFGPGTKLEIK |

TABLE 2.2-continued

SEQUENCES OF HEAVY CHAIN VARIABLE REGIONS (VH) AND LIGHT CHAIN VARIABLE REGIONS (VL) OF TL1A BINDING PROTEINS (ANTIBODY 1-4, 11-119)

| Antibody | SEQ ID NO | VH | SEQ ID NO | VL |
|---|---|---|---|---|
| Antibody 102 | 2366 | EVQLVQSGAEVKKPGAS VKVSCKASGYTFNGYY MHWIRQAPGQGLEWMG WINPNSGGTKYSQKFQG RVTMTRDTSISTAYMELS RLRSDDTAVYYCATGGS FDAFDIWGQGTMVTVSS | 2475 | DIQMTQSPSSLSASVGDRVTITCR ASQSISSYLNWYQQKPGKAPKFL IYGASRLQSGVPSRFSGSGSGTDF TLTISSLQPEDFATYYCQQGYSSP FTFGPGTKVDIK |
| Antibody 103 | 2367 | EVQLVQSGAEVKKPGAS VKVSCKASGYTFTGYYM HWVRQAPGQGLEWMG WINPNSGGTNYAQKFQG RVTMTRDTSISTAYMELS RLRSDDTAVYYCAVGGS YDAFDIWGQGTMVTVSS | 2476 | DIQMTQSPSSLSASVGDRVTITCR ASQSISSYLNWYQQKPGKAPKFL IYGASRLQSGVPSRFSGSGSGTDF TLTISSLQPEDFATYYCQQGYSNP FTFGPGTKVDIK |
| Antibody 104 | 2368 | EVQLVESGAEVKKPGAS VKVSCKASGYTFTAYYM HWVRQAPGQGLEWMG WINPNSGGTNYAQKFQG RVTMTRDTSINTAYMEL SRLRSDDTAVYYCASGG SIDAFDIWGQGTMVTVS S | 2477 | DIVMTQSPSSLSASVGDRVTITCR ASQSISSYLNWYQQKPGKAPKLL IYGASRLQSGVPSRFSGSGSGTDF TLTISSLQPEDFATYYCQQGFSTP FTFGPGTKLEIK |
| Antibody 105 | 2369 | QVQLVQSEAEVKKPGAS VKVSCKASGYTFTAYYI HWVRQAPGQGLEWMG WINPNSGGTNYAQKFQD RVTMTGDTSISTAYMEL RRLRSDDTAVYYCAVGG SYDAFDIWGQGTMVTVS S | 2478 | DIQMTQSPSSLSASVGDRVTITCR ASQSISSYLNWYQQKPGKAPKFL IYGASRLQSGVPSRFSGSGSGTDF TLTISSLQPEDFATYYCQQGYSSP FTFGPGTKVDIK |
| Antibody 106 | 2370 | EVQLVQSGAEVKKPGAS MKVSCKASGYTFTGYYI HWVRQAPGQGLEWMG WINPNSGGTKYAQKFHG RVTLTRDTSVNTAYMDL SGLRSDDTAVYYCAVGG SFDAFDIWGQGTMVTVS S | 2479 | DIVMTQSPSSLSASVGDRVTITCR ASQSISRYLNWYQQKPGKAPNFL IYGASRLQSGVPSRFSGSGSGTDF TLTISSLQPEDFATYYCQQGYSSP FTFGPGTKVDIK |
| Antibody 107 | 2371 | EVQLVQSGAEVKKPGAS VKVSCKASGYTFTGYYM HWVRQAPGQGLEWMG WINPNSGGTNYAQKFQG RVTMTRDTSISTAYMELS RLISDDTAVYYCVTGGSF DAFDVWGQGTMVTVSS | 2480 | DIQMTQSPSSLSASVGDRVTITCR ASQSISSYLNWYQQKPGKAPKILI YGASSLQSGVPSRFSGSGSGTDFT LAISSLQPEDFATYYCQQGDSTPF TFGPGTKVDIK |
| Antibody 108 | 2372 | QVQLVQSGAEVKKPGAS VRVSCKASGYTFTGYYM HWVRQAPGQGLEWMG WINPNSGGTNYAQKFQG RVTVTRDTSISTAYMELS RLRSDDTAVYYCTSGGS FDAFDIWGQGTMVTVSS | 2481 | DIVMTQSPSSLSASVGDRVTITCR ASQSISSFLNWYQQSPGKAPKILI YGASRLQSGVPSRFSGSGSGTDF TLAISSLQPEDFATYYCQQGDSTP FTFGPGTKVDIK |
| Antibody 109 | 2373 | EVQLVQSGAEVKRPGAS LTVSCKSSGYTFTAYYIH WVRQAPGQGLEWMGWI NPNSGGTNYAQRFQGRV TMTRDTSISTAYMELSRL RSDDTAVYYCATGGSFD AFDIWGQGTMVTVSS | 2482 | DIQMTQSPSSLSASVGDRVTITCR ASQSISSYLNWYQQKPGKAPKFL IYGASSLQSGVPSRFSGSGSGTDF TLTISSLQPEDFATYYCQQGHSTP FTFGPGTKVDIK |

TABLE 2.2-continued

SEQUENCES OF HEAVY CHAIN VARIABLE REGIONS (VH) AND LIGHT CHAIN VARIABLE REGIONS (VL) OF TL1A BINDING PROTEINS (ANTIBODY 1-4, 11-119)

| Antibody | SEQ ID NO | VH | SEQ ID NO | VL |
|---|---|---|---|---|
| Antibody 110 | 2374 | EVQLVQSGAEVKKPGASVKVSCKASGYTFTGYYMHWVRQAPGQGLEWMGWINPKSGGTNYAQKFQGRVTMTRDTSISTAYMELSRLRSDDTAVYYCASGGSFDAFDIWGQGTMVTVSS | 2483 | DIVMTQSPSSLSASVGDRVTITCRASQSISSYLNWYQQKPGKAPKFLIYGASSLQSGVPSRFSGSGSGTDFTLTISSLQPEDFAAYYCQQGHSTPFTFGPGTKVDIK |
| Antibody 111 | 2375 | EVQLVESGAEVKKPGASVRVSCKASGYTFTAYYIHWVRQAPGQGLEWMGWINPNSGGTSSAQKFQGRVTMTRDTSISTAYMDLNRLRSDDTAMYYCAVGGSFDAFDIWGQGTMVTVSS | 2484 | DIVMTQSPSSLSASVGDRVTITCRASQSISSYLNWYQQKPGKAPKLLIYGASRLQSGVPSRFSGSGSGTDFTLTISSLQPEDFASYFCQQGHSTPITFGQGTKLEIK |
| Antibody 112 | 2376 | EVQLVQSGAEVKRPGASVKVSCKASGYTFTGYYMHWVRQAPGQGLEWMGWINPNSGGTNYAQKFQGRVTMTRDTSISTAYLELSRLRSDDTAVYYCATGGSYDAFDIWGQGTMVTVSS | 2485 | DIQLTQSPSSLSASVGDRVTITCRASQSISSYLNWYQQKPGKAPKFLIYGASRLQSGVPSRFSGSGSGTDFTLTISSLQPEDFATYFCQQGYSSPFTFGPGTKVDIK |
| Antibody 113 | 2377 | QVQLVQSGAEVKKPGASVKVSCKASGYTFTGYYMHWVRQAPGQGLEWMGWINPNSGGTKYAQKFQGRVTMTRDTSISTAYMELSSLRSDDTAVYYCATGGSYDAFDIWGQGTMVTVSS | 2486 | DIVLTQSPSSLSASVGDRVTITCRASQSISRYLYWYQQNPGKAPKLLIYAASSLQSGVPSRFSGSGSGTDFTLTISSLQPEDFATYYCQQGYDTPFTFGPGTKVDIK |
| Antibody 114 | 2378 | EVQLVESGAEVKKPGASVKVSCKASGYTFTGYYMHWVRQAPGQGLEWMGWINPKSGGTNYAQKFQGRVTMTRDTSISTAYMELSRLRSDDTAVYYCATGGSFDAFDIWGQGTMVTVSS | 2487 | DIQLTQSPSSLSASVGDRVTITCQASQDISNYLNWYQQKPGKAPKLLIYAASSLQTGVPSRFSGSGSGTDFTLAISSLQPEDFATYYCQQGDSTPFTFGPGTKLEIK |
| Antibody 115 | 2379 | QVQLVQSGSDLKKPGASVKVSCKASGYTFTRYGMNWVRQAPGQGLEWMGWINTNTGNPTYAQDFTGRFVFSLDTSVSTAYLQISSLKAEDTAVYYCARDNWNYVSDYWGQGTLVTVSS | 2488 | EIVLTQSPGTLSLSPGERATLSCRASQSVSDSYLAWYQQKPGQAPRLLIYGASSRATGIPDRFSGSGSGTDFTLTISRLEPEDFAVYYCQQYGTSPITFGQGTKLEIK |
| Antibody 116 | 2380 | EVQLVQSGAEVKKPGASVKVSCKASGYTFTGYYMHWVRQAPGQGLEWMGWINPKSGGTIYAQKFQGRVTMTRDTSISTAYMELSRLRSDDTAVYSCATGGSFDAFDIWGQGTMVTVSS | 2489 | DIQMTQSPSSLSASVGDRVIITCRASQSISSYLNWYQQKPGKAPKLLIYGASSLQSGVPSRFSGSGAGTEFTLTISSLQPEDFATYYCQQAKSFPLTFGGGTKVEIK |
| Antibody 117 | 2381 | EVQLVESGAEVKKPGASVKVSCKASGYTFTVYYMHWVRQAPGQGLEWMGWINPNSGGTNYAQKFQGRVTMTRDTSISTAYMELSRLRSDDTAVYYCASGGSFDAFDIWGQGTMVTVSS | 2490 | DIVMTQSPSSLSASVGDRVTITCRASQSISSYLNWYQQKPGKAPKFLIYGASRLQSGVPSRFSGSGSGTDFTLTISSLQPEDFATYYCQQGYSSPFTFGGGTKVDIK |
| Antibody 118 | 2382 | QVQLVQSGSELQKPGASVKVSCKTSGYTFTRYGMNWVRQAPGQGLEWMGWINTNTGNPTYAQGFTGRFVFSLDTSVSTAYLQISSLKAEDTAVYYCARDNWNYDFDYWGQGTTVTVSS | 2491 | DIVMTQTPLSSPVPLGQPASISCKSSQSLVHSDGNTYLSWLQQRPGQPPRLLIYKISNRFSGVPDRFSGSGAGTDFTLKISRVEAEDVGVYYCMQVTQFPITLGQGTKLEIK |

TABLE 2.2-continued

SEQUENCES OF HEAVY CHAIN VARIABLE REGIONS (VH) AND LIGHT CHAIN VARIABLE REGIONS (VL) OF TL1A BINDING PROTEINS (ANTIBODY 1-4, 11-119)

| Antibody | SEQ ID NO | VH | SEQ ID NO | VL |
|---|---|---|---|---|
| Antibody 119 | 2383 | QVQLVQSGSELKRPGAS VKVSCKASGYTFTTYGM NWVRQAPGQGLEWMG WINTNTGNPTYAQGFTG RFVFSLDTSVSTAYLQISS LKAEDTAVYYCARDNW NYDLDYWGQGTLVTVS S | 2492 | DIVMTQTPLSSPVTLGQPASISCR SSQSLVHSDGNTYLSWLQQRPGQ PPRLLIYKISNRFSGVPDRFSGSG AGTDFTLKISRVEAEDVGVYYC MQATQFPITLGQGTKLEIK |

In some embodiments, the TL1A binding protein comprises a heavy chain variable region (VH) comprising an amino acid sequence having at least 80% sequence identity with an amino acid sequence according to any one of VH sequences listed in TABLE 2.1 and TABLE 2.2. In some embodiments, the TL1A binding protein comprises a heavy chain variable region (VH) comprising an amino acid sequence having at least 85% sequence identity with an amino acid sequence according to any one of VH sequences listed in TABLE 2.1 and TABLE 2.2 (SEQ ID NOs: 181-190 and 2275-2383). In some embodiments, the TL1A binding protein comprises a heavy chain variable region (VH) comprising an amino acid sequence having at least 90% sequence identity with an amino acid sequence according to any one of VH sequences listed in TABLE 2.1 and TABLE 2.2. In some embodiments, the TL1A binding protein comprises a heavy chain variable region (VH) comprising an amino acid sequence having at least 95% sequence identity with an amino acid sequence according to any one of VH sequences listed in TABLE 2.1 and TABLE 2.2. In some embodiments, the TL1A binding protein comprises a heavy chain variable region (VH) comprising an amino acid sequence having at least 96% sequence identity with an amino acid sequence according to any one of VH sequences listed in TABLE 2.1 and TABLE 2.2. In some embodiments, the TL1A binding protein comprises a heavy chain variable region (VH) comprising an amino acid sequence having at least 97% sequence identity with an amino acid sequence according to any one of VH sequences listed in TABLE 2.1 and TABLE 2.2. In some embodiments, the TL1A binding protein comprises a heavy chain variable region (VH) comprising an amino acid sequence having at least 98% sequence identity with an amino acid sequence according to any one of VH sequences listed in TABLE 2.1 and TABLE 2.2. In some embodiments, the TL1A binding protein comprises a heavy chain variable region (VH) comprising an amino acid sequence having at least 99% sequence identity with an amino acid sequence according to any one of VH sequences listed in TABLE 2.1 and TABLE 2.2. In some embodiments, the TL1A binding protein comprises a heavy chain variable region (VH) comprising an amino acid sequence according to any one of VH sequences listed in TABLE 2.1 and TABLE 2.2.

In some embodiments, the TL1A binding protein comprises a light chain variable region (VL) comprising an amino acid sequence having at least 80% sequence identity with an amino acid sequence according to any one of VL sequences listed in TABLE 2.1 and TABLE 2.2 (SEQ ID NOs: 191-200 and 2384-2492). In some embodiments, the TL1A binding protein comprises a light chain variable region (VL) comprising an amino acid sequence having at least 85% sequence identity with an amino acid sequence according to any one of VL sequences listed in TABLE 2.1 and TABLE 2.2. In some embodiments, the TL1A binding protein antibody comprises a light chain variable region (VL) comprising an amino acid sequence having at least 90% sequence identity with an amino acid sequence according to any one of VL sequences listed in TABLE 2.1 and TABLE 2.2. In some embodiments, the TL1A binding protein comprises a light chain variable region (VL) comprising an amino acid sequence having at least 95% sequence identity with an amino acid sequence according to any one of VL sequences listed in TABLE 2.1 and TABLE 2.2. In some embodiments, the TL1A binding protein comprises a light chain variable region (VL) comprising an amino acid sequence having at least 96% sequence identity with an amino acid sequence according to any one of VL sequences listed in TABLE 2.1 and TABLE 2.2. In some embodiments, the TL1A binding protein comprises a light chain variable region (VL) comprising an amino acid sequence having at least 97% sequence identity with an amino acid sequence according to any one of VL sequences listed in TABLE 2.1 and TABLE 2.2. In some embodiments, the TL1A binding protein comprises a light chain variable region (VL) comprising an amino acid sequence having at least 98% sequence identity with an amino acid sequence according to any one of VL sequences listed in TABLE 2.1 and TABLE 2.2. In some embodiments, the TL1A binding protein comprises a light chain variable region (VL) comprising an amino acid sequence having at least 99% sequence identity with an amino acid sequence according to any one of VL sequences listed in TABLE 2.1 and TABLE 2.2. In some embodiments, the TL1A binding protein comprises a light chain variable region (VL) comprising an amino acid sequence according to any one of VL sequences listed in TABLE 2.1 and TABLE 2.2.

In some embodiments, the TL1A binding protein comprises a heavy chain variable region (VH) that comprises an amino acid sequence at least 60% (e.g., at least 70%, at least 80%, at least 85%, at least 90%, at least 91%, at least 92%, at least 93%, at least 94%, at least 95%, at least 96%, at least 97%, at least 98%, at least 99%, or 100%) identical to the heavy chain variable region (VH) of an TL1A binding protein disclosed in TABLE 2.1 and TABLE 2.2, and a light chain variable region (VL) that comprises an amino acid sequence at least 60% (e.g., at least 70%, at least 80%, at least 85%, at least 90%, at least 91%, at least 92%, at least 93%, at least 94%, at least 95%, at least 96%, at least 97%, at least 98%, at least 99%, or 100%) identical to the light chain variable region (VL) of the same TL1A binding protein disclosed in TABLE 2.1 and TABLE 2.2.

In some embodiments, the TL1A binding protein comprises a heavy chain variable region comprising an amino acid sequence having at least 80% sequence identity with an amino acid sequence according to any one of VH sequences listed in TABLE 2.1 and TABLE 2.2 (SEQ ID NOs: 181-190 and 2275-2383); and a light chain variable region comprising an amino acid sequence having at least 80% sequence identity with an amino acid sequence according to any one of VL sequences listed in TABLE 2.1 and TABLE 2.2 (SEQ ID NOs: 191-200 and 2384-2492). In some embodiments, the TL1A binding protein comprises a heavy chain variable region comprising an amino acid sequence having at least 85% sequence identity with an amino acid sequence according to any one of VH sequences listed in TABLE 2.1 and TABLE 2.2 (SEQ ID NOs: 181-190 and 2275-2383); and a light chain variable region comprising an amino acid sequence having at least 85% sequence identity with an amino acid sequence according to any one of VL sequences listed in TABLE 2.1 and TABLE 2.2 (SEQ ID NOs: 191-200 and 2384-2492). In some embodiments, the TL1A binding protein comprises a heavy chain variable region comprising an amino acid sequence having at least 90% sequence identity with an amino acid sequence according to any one of VH sequences listed in TABLE 2.1 and TABLE 2.2 (SEQ ID NOs: 181-190 and 2275-2383); and a light chain variable region comprising an amino acid sequence having at least 90% sequence identity with an amino acid sequence according to any one of VL sequences listed in TABLE 2.1 and TABLE 2.2 (SEQ ID NOs: 191-200 and 2384-2492). In some embodiments, the TL1A binding protein comprises a heavy chain variable region comprising an amino acid sequence having at least 95% sequence identity with an amino acid sequence according to any one of VH sequences listed in TABLE 2.1 and TABLE 2.2 (SEQ ID NOs: 181-190 and 2275-2383); and a light chain variable region comprising an amino acid sequence having at least 95% sequence identity with an amino acid sequence according to any one of VL sequences listed in TABLE 2.1 and TABLE 2.2 (SEQ ID NOs: 191-200 and 2384-2492). In some embodiments, the TL1A binding protein comprises a heavy chain variable region comprising an amino acid sequence having at least 96% sequence identity with an amino acid sequence according to any one of VH sequences listed in TABLE 2.1 and TABLE 2.2 (SEQ ID NOs: 181-190 and 2275-2383); and a light chain variable region comprising an amino acid sequence having at least 96% sequence identity with an amino acid sequence according to any one of VL sequences listed in TABLE 2.1 and TABLE 2.2 (SEQ ID NOs: 191-200 and 2384-2492). In some embodiments, the TL1A binding protein comprises a heavy chain variable region comprising an amino acid sequence having at least 97% sequence identity with an amino acid sequence according to any one of VH sequences listed in TABLE 2.1 and TABLE 2.2 (SEQ ID NOs: 181-190 and 2275-2383); and a light chain variable region comprising an amino acid sequence having at least 97% sequence identity with an amino acid sequence according to any one of VL sequences listed in TABLE 2.1 and TABLE 2.2 (SEQ ID NOs: 191-200 and 2384-2492). In some embodiments, the TL1A binding protein comprises a heavy chain variable region comprising an amino acid sequence having at least 98% sequence identity with an amino acid sequence according to any one of VH sequences listed in TABLE 2.1 and TABLE 2.2 (SEQ ID NOs: 181-190 and 2275-2383); and a light chain variable region comprising an amino acid sequence having at least 98% sequence identity with an amino acid sequence according to any one of VL sequences listed in TABLE 2.1 and TABLE 2.2 (SEQ ID NOs: 191-200 and 2384-2492). In some embodiments, the TL1A binding protein comprises a heavy chain variable region comprising an amino acid sequence having at least 99% sequence identity with an amino acid sequence according to any one of VH sequences listed in TABLE 2.1 and TABLE 2.2 (SEQ ID NOs: 181-190 and 2275-2383); and a light chain variable region comprising an amino acid sequence having at least 99% sequence identity with an amino acid sequence according any one of VL sequences listed in TABLE 2.1 and TABLE 2.2 (SEQ ID NOs: 191-200 and 2384-2492). In some embodiments, the TL1A binding protein comprises a heavy chain variable region comprising an amino acid sequence according to any one of VH sequences listed in TABLE 2.1 and TABLE 2.2 (SEQ ID NOs: 181-190) and 2275-2383); and a light chain variable region comprising an amino acid sequence according to any one of VL sequences listed in TABLE 2.1 and TABLE 2.2 (SEQ ID NOs: 191-200 and 2384-2492).

In some embodiments, the TL1A binding protein comprises a heavy chain variable region comprising an amino acid sequence having at least 80% sequence identity with an amino acid sequence listed in TABLE 2.1; and a light chain variable region comprising an amino acid sequence having at least 80% sequence identity with an amino acid sequence listed in TABLE 2.1. In some embodiments, the TL1A binding protein comprises a heavy chain variable region comprising an amino acid sequence having at least 85% sequence identity with an amino acid sequence listed in TABLE 2.1; and a light chain variable region comprising an amino acid sequence having at least 85% sequence identity with an amino acid sequence listed in TABLE 2.1. In some embodiments, the TL1A binding protein comprises a heavy chain variable region comprising an amino acid sequence having at least 90% sequence identity with an amino acid sequence listed in TABLE 2.1; and a light chain variable region comprising an amino acid sequence having at least 90% sequence identity with an amino acid sequence listed in TABLE 2.1. In some embodiments, the TL1A binding protein comprises a heavy chain variable region comprising an amino acid sequence having at least 95% sequence identity with an amino acid sequence listed in TABLE 2.1; and a light chain variable region comprising an amino acid sequence having at least 95% sequence identity with an amino acid sequence listed in TABLE 2.1. In some embodiments, the TL1A binding protein comprises a heavy chain variable region comprising an amino acid sequence having at least 96% sequence identity with an amino acid sequence listed in TABLE 2.1; and a light chain variable region comprising an amino acid sequence having at least 96% sequence identity with an amino acid sequence listed in TABLE 2.1. In some embodiments, the TL1A binding protein comprises a heavy chain variable region comprising an amino acid sequence having at least 97% sequence identity with an amino acid sequence listed in TABLE 2.1; and a light chain variable region comprising an amino acid sequence having at least 97% sequence identity with an amino acid sequence listed in TABLE 2.1. In some embodiments, the TL1A binding protein comprises a heavy chain variable region comprising an amino acid sequence having at least 98% sequence identity with an amino acid sequence listed in TABLE 2.1; and a light chain variable region comprising an amino acid 20) sequence having at least 98% sequence identity with an amino acid sequence listed in TABLE 2.1. In some embodiments, the TL1A binding protein comprises a heavy chain variable region comprising an amino acid sequence having at least 99% sequence identity with an amino acid sequence listed in TABLE 2.1;

and a light chain variable region comprising an amino acid sequence having at least 99% sequence identity with an amino acid sequence listed in TABLE 2.1. In some embodiments, the TL1A binding protein comprises a heavy chain variable region comprising an amino acid sequence listed in TABLE 2.1; and a light chain variable region comprising an amino acid sequence listed in TABLE 2.1.

In some embodiments, the TL1A binding protein comprises a heavy chain variable region comprising an amino acid sequence having at least 80% sequence identity with an amino acid sequence listed in TABLE 2.2; and a light chain variable region comprising an amino acid sequence having at least 80% sequence identity with an amino acid sequence listed in TABLE 2.2. In some embodiments, the TL1A binding protein comprises a heavy chain variable region comprising an amino acid sequence having at least 85% sequence identity with an amino acid sequence listed in TABLE 2.2; and a light chain variable region comprising an amino acid sequence having at least 85% sequence identity with an amino acid sequence listed in TABLE 2.2. In some embodiments, the TL1A binding protein comprises a heavy chain variable region comprising an amino acid sequence having at least 90% sequence identity with an amino acid sequence listed in TABLE 2.2; and a light chain variable region comprising an amino acid sequence having at least 90% sequence identity with an amino acid sequence listed in TABLE 2.2. In some embodiments, the TL1A binding protein comprises a heavy chain variable region comprising an amino acid sequence having at least 95% sequence identity with an amino acid sequence listed in TABLE 2.2; and a light chain variable region comprising an amino acid sequence having at least 95% sequence identity with an amino acid sequence listed in TABLE 2.2. In some embodiments, the TL1A binding protein comprises a heavy chain variable region comprising an amino acid sequence having at least 96% sequence identity with an amino acid sequence listed in TABLE 2.2; and a light chain variable region comprising an amino acid sequence having at least 96% sequence identity with an amino acid sequence listed in TABLE 2.2. In some embodiments, the TL1A binding protein comprises a heavy chain variable region comprising an amino acid sequence having at least 97% sequence identity with an amino acid sequence listed in TABLE 2.2; and a light chain variable region comprising an amino acid sequence having at least 97% sequence identity with an amino acid sequence listed in TABLE 2.2. In some embodiments, the TL1A binding protein comprises a heavy chain variable region comprising an amino acid sequence having at least 98% sequence identity with an amino acid sequence listed in TABLE 2.2; and a light chain variable region comprising an amino acid sequence having at least 98% sequence identity with an amino acid sequence listed in TABLE 2.2. In some embodiments, the TL1A binding protein comprises a heavy chain variable region comprising an amino acid sequence having at least 99% sequence identity with an amino acid sequence listed in TABLE 2.2; and a light chain variable region comprising an amino acid sequence having at least 99% sequence identity with an amino acid sequence listed in TABLE 2.2. In some embodiments, the TL1A binding protein comprises a heavy chain variable region comprising an amino acid sequence listed in TABLE 2.2; and a light chain variable region comprising an amino acid sequence listed in TABLE 2.2.

In some embodiments, the TL1A binding protein comprises a heavy chain variable region comprising an amino acid sequence having at least 80% sequence identity with an amino acid sequence according to SEQ ID NO: 181; and a light chain variable region comprising an amino acid sequence having at least 80% sequence identity with an amino acid sequence according to SEQ ID NO: 191. In some embodiments, the TL1A binding protein comprises a heavy chain variable region comprising an amino acid sequence having at least 85% sequence identity with an amino acid sequence according to SEQ ID NO: 181; and a light chain variable region comprising an amino acid sequence having at least 85% sequence identity with an amino acid sequence according to SEQ ID NO: 191. In some embodiments, the TL1A binding protein comprises a heavy chain variable region comprising an amino acid sequence having at least 90% sequence identity with an amino acid sequence according to SEQ ID NO: 181; and a light chain variable region comprising an amino acid sequence having at least 90% sequence identity with an amino acid sequence according to SEQ ID NO: 191. In some embodiments, the TL1A binding protein comprises a heavy chain variable region comprising an amino acid sequence having at least 95% sequence identity with an amino acid sequence according to SEQ ID NO: 181; and a light chain variable region comprising an amino acid sequence having at least 95% sequence identity with an amino acid sequence according to SEQ ID NO: 191. In some embodiments, the TL1A binding protein comprises a heavy chain variable region comprising an amino acid sequence having at least 96% sequence identity with an amino acid sequence according to SEQ ID NO: 181; and a light chain variable region comprising an amino acid sequence having at least 96% sequence identity with an amino acid sequence according to SEQ ID NO: 191. In some embodiments, the TL1A binding protein comprises a heavy chain variable region comprising an amino acid sequence having at least 97% sequence identity with an amino acid sequence according to SEQ ID NO: 181; and a light chain variable region comprising an amino acid sequence having at least 97% sequence identity with an amino acid sequence according to SEQ ID NO: 191. In some embodiments, the TL1A binding protein comprises a heavy chain variable region comprising an amino acid sequence having at least 98% sequence identity with an amino acid sequence according to SEQ ID NO: 181; and a light chain variable region comprising an amino acid sequence having at least 98% sequence identity with an amino acid sequence according to SEQ ID NO: 191. In some embodiments, the TL1A binding protein comprises a heavy chain variable region comprising an amino acid sequence having at least 99% sequence identity with an amino acid sequence according to SEQ ID NO: 181; and a light chain variable region comprising an amino acid sequence having at least 99% sequence identity with an amino acid sequence according SEQ ID NO: 191. In some embodiments, the TL1A binding protein comprises a heavy chain variable region comprising an amino acid sequence according to SEQ ID NO: 181; and a light chain variable region comprising an amino acid sequence according to SEQ ID NO: 191.

In some embodiments, the TL1A binding protein comprises a heavy chain variable region comprising an amino acid sequence having at least 80% sequence identity with an amino acid sequence according to SEQ ID NO: 182; and a light chain variable region comprising an amino acid sequence having at least 80% sequence identity with an amino acid sequence according to SEQ ID NO: 192. In some embodiments, the TL1A binding protein comprises a heavy chain variable region comprising an amino acid sequence having at least 85% sequence identity with an amino acid sequence according to SEQ ID NO: 182; and a light chain variable region comprising an amino acid sequence having at least 85% sequence identity with an amino acid sequence according to SEQ ID NO: 192. In some embodiments, the TL1A binding protein comprises a heavy chain variable region comprising an amino acid sequence having at least 90% sequence identity with an amino acid sequence according to SEQ ID NO: 182; and a light chain variable region comprising an amino acid sequence having at least 90% sequence identity with an amino acid sequence according to SEQ ID NO: 192. In some embodiments, the TL1A binding protein comprises a heavy chain variable region comprising an amino acid sequence having at least 95% sequence identity with an amino acid sequence according to SEQ ID NO: 182; and a light chain variable region comprising an amino acid sequence having at least 95% sequence identity with an amino acid sequence according to SEQ ID NO: 192. In some embodiments, the TL1A binding protein comprises a heavy chain variable region comprising an amino acid sequence having at least 96% sequence identity with an amino acid sequence according to SEQ ID NO: 182; and a light chain variable region comprising an amino acid sequence having at least 96% sequence identity with an amino acid sequence according to SEQ ID NO: 192. In some embodiments, the TL1A binding protein comprises a heavy chain variable region comprising an amino acid sequence having at least 97% sequence identity with an amino acid sequence according to SEQ ID NO: 182; and a light chain variable region comprising an amino acid sequence having at least 97% sequence identity with an amino acid sequence according to SEQ ID NO: 192. In some embodiments, the TL1A binding protein comprises a heavy chain variable region comprising an amino acid sequence having at least 98% sequence identity with an amino acid sequence according to SEQ ID NO: 182; and a light chain variable region comprising an amino acid sequence having at least 98% sequence identity with an amino acid sequence according to SEQ ID NO: 192. In some embodiments, the TL1A binding protein comprises a heavy chain variable region comprising an amino acid sequence having at least 99% sequence identity with an amino acid sequence according to SEQ ID NO: 182; and a light chain variable region comprising an amino acid sequence having at least 99% sequence identity with an amino acid sequence according SEQ ID NO: 192. In some embodiments, the TL1A binding protein comprises a heavy chain variable region comprising an amino acid sequence according to SEQ ID NO: 182; and a light chain variable region comprising an amino acid sequence according to SEQ ID NO: 192.

In some embodiments, the TL1A binding protein comprises a heavy chain variable region comprising an amino acid sequence having at least 80% sequence identity with an amino acid sequence according to SEQ ID NO: 183; and a light chain variable region comprising an amino acid sequence having at least 80% sequence identity with an amino acid sequence according to SEQ ID NO: 193. In some embodiments, the TL1A binding protein comprises a heavy chain variable region comprising an amino acid sequence having at least 85% sequence identity with an amino acid sequence according to SEQ ID NO: 183; and a light chain variable region comprising an amino acid sequence having at least 85% sequence identity with an amino acid sequence according to SEQ ID NO: 193. In some embodiments, the TL1A binding protein comprises a heavy chain variable region comprising an amino acid sequence having at least 90% sequence identity with an amino acid sequence according to SEQ ID NO: 183; and a light chain variable region comprising an amino acid sequence having at least 90% sequence identity with an amino acid sequence according to SEQ ID NO: 193. In some embodiments, the TL1A binding protein comprises a heavy chain variable region comprising an amino acid sequence having at least 95% sequence identity with an amino acid sequence according to SEQ ID NO: 183; and a light chain variable region comprising an amino acid sequence having at least 95% sequence identity with an amino acid sequence according to SEQ ID NO: 193. In some embodiments, the TL1A binding protein comprises a heavy chain variable region comprising an amino acid sequence having at least 96% sequence identity with an amino acid sequence according to SEQ ID NO: 183; and a light chain variable region comprising an amino acid sequence having at least 96% sequence identity with an amino acid sequence according to SEQ ID NO: 193. In some embodiments, the TL1A binding protein comprises a heavy chain variable region comprising an amino acid sequence having at least 97% sequence identity with an amino acid sequence according to SEQ ID NO: 183; and a light chain variable region comprising an amino acid sequence having at least 97% sequence identity with an amino acid sequence according to SEQ ID NO: 193. In some embodiments, the TL1A binding protein comprises a heavy chain variable region comprising an amino acid sequence having at least 98% sequence identity with an amino acid sequence according to SEQ ID NO: 183; and a light chain variable region comprising an amino acid sequence having at least 98% sequence identity with an amino acid sequence according to SEQ ID NO: 193. In some embodiments, the TL1A binding protein comprises a heavy chain variable region comprising an amino acid sequence having at least 99% sequence identity with an amino acid sequence according to SEQ ID NO: 183; and a light chain variable region comprising an amino acid sequence having at least 99% sequence identity with an amino acid sequence according SEQ ID NO: 193. In some embodiments, the TL1A binding protein comprises a heavy chain variable region comprising an amino acid sequence according to SEQ ID NO: 183; and a light chain variable region comprising an amino acid sequence according to SEQ ID NO: 193.

In some embodiments, the TL1A binding protein comprises a heavy chain variable region comprising an amino acid sequence having at least 80% sequence identity with an amino acid sequence according to SEQ ID NO: 184; and a light chain variable region comprising an amino acid sequence having at least 80% sequence identity with an amino acid sequence according to SEQ ID NO: 194. In some embodiments, the TL1A binding protein comprises a heavy chain variable region comprising an amino acid sequence having at least 85% sequence identity with an amino acid sequence according to SEQ ID NO: 184; and a light chain variable region comprising an amino acid sequence having at least 85% sequence identity with an amino acid sequence according to SEQ ID NO: 194. In some embodiments, the TL1A binding protein comprises a heavy chain variable region comprising an amino acid sequence having at least 90% sequence identity with an amino acid sequence according to SEQ ID NO: 184; and a light chain variable region comprising an amino acid sequence having at least 90% sequence identity with an amino acid sequence according to SEQ ID NO: 194. In some embodiments, the TL1A binding protein comprises a heavy chain variable region comprising an amino acid sequence having at least 95% sequence identity with an amino acid sequence according to SEQ ID NO: 184; and a light chain variable region comprising an amino acid sequence having at least 95% sequence identity with an amino acid sequence according to SEQ ID NO: 194. In some embodiments, the TL1A binding protein comprises a heavy chain variable region comprising an amino acid sequence having at least 96% sequence identity with an amino acid sequence according to SEQ ID NO: 184; and a light chain variable region comprising an amino acid sequence having at least 96% sequence identity with an amino acid sequence according to SEQ ID NO: 194. In some embodiments, the TL1A binding protein comprises a heavy chain variable region comprising an amino acid sequence having at least 97% sequence identity with an amino acid sequence according to SEQ ID NO: 184; and a light chain variable region comprising an amino acid sequence having at least 97% sequence identity with an amino acid sequence according to SEQ ID NO: 194. In some embodiments, the TL1A binding protein comprises a heavy chain variable region comprising an amino acid sequence having at least 98% sequence identity with an amino acid sequence according to SEQ ID NO: 184; and a light chain variable region comprising an amino acid sequence having at least 98% sequence identity with an amino acid sequence according to SEQ ID NO: 194. In some embodiments, the TL1A binding protein comprises a heavy chain variable region comprising an amino acid sequence having at least 99% sequence identity with an amino acid sequence according to SEQ ID NO: 184; and a light chain variable region comprising an amino acid sequence having at least 99% sequence identity with an amino acid sequence according SEQ ID NO: 194. In some embodiments, the TL1A binding protein comprises a heavy chain variable region comprising an amino acid sequence according to SEQ ID NO: 184; and a light chain variable region comprising an amino acid sequence according to SEQ ID NO: 194.

In some embodiments, the TL1A binding protein comprises a heavy chain variable region comprising an amino acid sequence having at least 80% sequence identity with an amino acid sequence according to SEQ ID NO: 185; and a light chain variable region comprising an amino acid sequence having at least 80% sequence identity with an amino acid sequence according to SEQ ID NO: 195. In some embodiments, the TL1A binding protein comprises a heavy chain variable region comprising an amino acid sequence having at least 85% sequence identity with an amino acid sequence according to SEQ ID NO: 185; and a light chain variable region comprising an amino acid sequence having at least 85% sequence identity with an amino acid sequence according to SEQ ID NO: 195. In some embodiments, the TL1A binding protein comprises a heavy chain variable region comprising an amino acid sequence having at least 90% sequence identity with an amino acid sequence according to SEQ ID NO: 185; and a light chain variable region comprising an amino acid sequence having at least 90% sequence identity with an amino acid sequence according to SEQ ID NO: 195. In some embodiments, the TL1A binding protein comprises a heavy chain variable region comprising an amino acid sequence having at least 95% sequence identity with an amino acid sequence according to SEQ ID NO: 185; and a light chain variable region comprising an amino acid sequence having at least 95% sequence identity with an amino acid sequence according to SEQ ID NO: 195. In some embodiments, the TL1A binding protein comprises a heavy chain variable region comprising an amino acid sequence having at least 96% sequence identity with an amino acid sequence according to SEQ ID NO: 185; and a light chain variable region comprising an amino acid sequence having at least 96% sequence identity with an amino acid sequence according to SEQ ID NO: 195. In some embodiments, the TL1A binding protein comprises a heavy chain variable region comprising an amino acid sequence having at least 97% sequence identity with an amino acid sequence according to SEQ ID NO: 185; and a light chain variable region comprising an amino acid sequence having at least 97% sequence identity with an amino acid sequence according to SEQ ID NO: 195. In some embodiments, the TL1A binding protein comprises a heavy chain variable region comprising an amino acid sequence having at least 98% sequence identity with an amino acid sequence according to SEQ ID NO: 185; and a light chain variable region comprising an amino acid sequence having at least 98% sequence identity with an amino acid sequence according to SEQ ID NO: 195. In some embodiments, the TL1A binding protein comprises a heavy chain variable region comprising an amino acid sequence having at least 99% sequence identity with an amino acid sequence according to SEQ ID NO: 185; and a light chain variable region comprising an amino acid sequence having at least 99% sequence identity with an amino acid sequence according SEQ ID NO: 195. In some embodiments, the TL1A binding protein comprises a heavy chain variable region comprising an amino acid sequence according to SEQ ID NO: 185; and a light chain variable region comprising an amino acid sequence according to SEQ ID NO: 195.

In some embodiments, the TL1A binding protein comprises a heavy chain variable region comprising an amino acid sequence having at least 80% sequence identity with an amino acid sequence according to SEQ ID NO: 186; and a light chain variable region comprising an amino acid sequence having at least 80% sequence identity with an amino acid sequence according to SEQ ID NO: 196. In some embodiments, the TL1A binding protein comprises a heavy chain variable region comprising an amino acid sequence having at least 85% sequence identity with an amino acid sequence according to SEQ ID NO: 186; and a light chain variable region comprising an amino acid sequence having at least 85% sequence identity with an amino acid sequence according to SEQ ID NO: 196. In some embodiments, the TL1A binding protein comprises a heavy chain variable region comprising an amino acid sequence having at least 90% sequence identity with an amino acid sequence according to SEQ ID NO: 186; and a light chain variable region comprising an amino acid sequence having at least 90% sequence identity with an amino acid sequence according to SEQ ID NO: 196. In some embodiments, the TL1A binding protein comprises a heavy chain variable region comprising an amino acid sequence having at least 95% sequence identity with an amino acid sequence according to SEQ ID NO: 186; and a light chain variable region comprising an amino acid sequence having at least 95% sequence identity with an amino acid sequence according to SEQ ID NO: 196. In some embodiments, the TL1A binding protein comprises a heavy chain variable region comprising an amino acid sequence having at least 96% sequence identity with an amino acid sequence according to SEQ ID NO: 186; and a light chain variable region comprising an amino acid sequence having at least 96% sequence identity with an amino acid sequence according to SEQ ID NO: 196. In some embodiments, the TL1A binding protein comprises a heavy chain variable region comprising an amino acid sequence having at least 97% sequence identity with an amino acid sequence according to SEQ ID NO: 186; and a light chain variable region comprising an amino acid sequence having at least 97% sequence identity with an amino acid sequence according to SEQ ID NO: 196. In some embodiments, the TL1A binding protein comprises a heavy chain variable region comprising an amino acid sequence having at least 98% sequence identity with an amino acid sequence according to SEQ ID NO: 186; and a light chain variable region comprising an amino acid sequence having at least 98% sequence identity with an amino acid sequence according to SEQ ID NO: 196. In some embodiments, the TL1A binding protein comprises a heavy chain variable region comprising an amino acid sequence having at least 99% sequence identity with an amino acid sequence according to SEQ ID NO: 186; and a light chain variable region comprising an amino acid sequence having at least 99% sequence identity with an amino acid sequence according SEQ ID NO: 196. In some embodiments, the TL1A binding protein comprises a heavy chain variable region comprising an amino acid sequence according to SEQ ID NO: 186; and a light chain variable region comprising an amino acid sequence according to SEQ ID NO: 196.

In some embodiments, the TL1A binding protein comprises a heavy chain variable region comprising an amino acid sequence having at least 80% sequence identity with an amino acid sequence according to SEQ ID NO: 187; and a light chain variable region comprising an amino acid sequence having at least 80% sequence identity with an amino acid sequence according to SEQ ID NO: 197. In some embodiments, the TL1A binding protein comprises a heavy chain variable region comprising an amino acid sequence having at least 85% sequence identity with an amino acid sequence according to SEQ ID NO: 187; and a light chain variable region comprising an amino acid sequence having at least 85% sequence identity with an amino acid sequence according to SEQ ID NO: 197. In some embodiments, the TL1A binding protein comprises a heavy chain variable region comprising an amino acid sequence having at least 90% sequence identity with an amino acid sequence according to SEQ ID NO: 187; and a light chain variable region comprising an amino acid sequence having at least 90% sequence identity with an amino acid sequence according to SEQ ID NO: 197. In some embodiments, the TL1A binding protein comprises a heavy chain variable region comprising an amino acid sequence having at least 95% sequence identity with an amino acid sequence according to SEQ ID NO: 187; and a light chain variable region comprising an amino acid sequence having at least 95% sequence identity with an amino acid sequence according to SEQ ID NO: 197. In some embodiments, the TL1A binding protein comprises a heavy chain variable region comprising an amino acid sequence having at least 96% sequence identity with an amino acid sequence according to SEQ ID NO: 187; and a light chain variable region comprising an amino acid sequence having at least 96% sequence identity with an amino acid sequence according to SEQ ID NO: 197. In some embodiments, the TL1A binding protein comprises a heavy chain variable region comprising an amino acid sequence having at least 97% sequence identity with an amino acid sequence according to SEQ ID NO: 187; and a light chain variable region comprising an amino acid sequence having at least 97% sequence identity with an amino acid sequence according to SEQ ID NO: 197. In some embodiments, the TL1A binding protein comprises a heavy chain variable region comprising an amino acid sequence having at least 98% sequence identity with an amino acid sequence according to SEQ ID NO: 187; and a light chain variable region comprising an amino acid sequence having at least 98% sequence identity with an amino acid sequence according to SEQ ID NO: 197. In some embodiments, the TL1A binding protein comprises a heavy chain variable region comprising an amino acid sequence having at least 99% sequence identity with an amino acid sequence according to SEQ ID NO: 187; and a light chain variable region comprising an amino acid sequence having at least 99% sequence identity with an amino acid sequence according SEQ ID NO: 197. In some embodiments, the TL1A binding protein comprises a heavy chain variable region comprising an amino acid sequence according to SEQ ID NO: 187; and a light chain variable region comprising an amino acid sequence according to SEQ ID NO: 197.

In some embodiments, the TL1A binding protein comprises a heavy chain variable region comprising an amino acid sequence having at least 80% sequence identity with an amino acid sequence according to SEQ ID NO: 188; and a light chain variable region comprising an amino acid sequence having at least 80% sequence identity with an amino acid sequence according to SEQ ID NO: 198. In some embodiments, the TL1A binding protein comprises a heavy chain variable region comprising an amino acid sequence having at least 85% sequence identity with an amino acid sequence according to SEQ ID NO: 188; and a light chain variable region comprising an amino acid sequence having at least 85% sequence identity with an amino acid sequence according to SEQ ID NO: 198. In some embodiments, the TL1A binding protein comprises a heavy chain variable region comprising an amino acid sequence having at least 90% sequence identity with an amino acid sequence according to SEQ ID NO: 188; and a light chain variable region comprising an amino acid sequence having at least 90% sequence identity with an amino acid sequence according to SEQ ID NO: 198. In some embodiments, the TL1A binding protein comprises a heavy chain variable region comprising an amino acid sequence having at least 95% sequence identity with an amino acid sequence according to SEQ ID NO: 188; and a light chain variable region comprising an amino acid sequence having at least 95% sequence identity with an amino acid sequence according to SEQ ID NO: 198. In some 25 embodiments, the TL1A binding protein comprises a heavy chain variable region comprising an amino acid sequence having at least 96% sequence identity with an amino acid sequence according to SEQ ID NO: 188; and a light chain variable region comprising an amino acid sequence having at least 96% sequence identity with an amino acid sequence according to SEQ ID NO: 198. In some embodiments, the TL1A binding protein comprises a heavy chain variable region comprising an amino acid sequence having at least 97% sequence identity with an amino acid sequence according to SEQ ID NO: 188; and a light chain variable region comprising an amino acid sequence having at least 97% sequence identity with an amino acid sequence according to SEQ ID NO: 198. In some embodiments, the TL1A binding protein comprises a heavy chain variable region comprising an amino acid sequence having at least 98% sequence identity with an amino acid sequence according to SEQ ID NO: 188; and a light chain variable region comprising an amino acid sequence having at least 98% sequence identity with an amino acid sequence according to SEQ ID NO: 198. In some embodiments, the TL1A binding protein comprises a heavy chain variable region comprising an amino acid sequence having at least 99% sequence identity with an amino acid sequence according to SEQ ID NO: 188; and a light chain variable region comprising an amino acid sequence having at least 99% sequence identity with an amino acid sequence according SEQ ID NO: 198. In some embodiments, the TL1A binding protein comprises a heavy chain variable region comprising an amino acid sequence according to SEQ ID NO: 188; and a light chain variable region comprising an amino acid sequence according to SEQ ID NO: 198.

In some embodiments, the TL1A binding protein comprises a heavy chain variable region comprising an amino acid sequence having at least 80% sequence identity with an amino acid sequence according to SEQ ID NO: 189; and a light chain variable region comprising an amino acid sequence having at least 80% sequence identity with an amino acid sequence according to SEQ ID NO: 199. In some embodiments, the TL1A binding protein comprises a heavy chain variable region comprising an amino acid sequence having at least 85% sequence identity with an amino acid sequence according to SEQ ID NO: 189; and a light chain variable region comprising an amino acid sequence having at least 85% sequence identity with an amino acid sequence according to SEQ ID NO: 199. In some embodiments, the TL1A binding protein comprises a heavy chain variable region comprising an amino acid sequence having at least 90% sequence identity with an amino acid sequence according to SEQ ID NO: 189; and a light chain variable region comprising an amino acid sequence having at least 90% sequence identity with an amino acid sequence according to SEQ ID NO: 199. In some embodiments, the TL1A binding protein comprises a heavy chain variable region comprising an amino acid sequence having at least 95% sequence identity with an amino acid sequence according to SEQ ID NO: 189; and a light chain variable region comprising an amino acid sequence having at least 95% sequence identity with an amino acid sequence according to SEQ ID NO: 199. In some embodiments, the TL1A binding protein comprises a heavy chain variable region comprising an amino acid sequence having at least 96% sequence identity with an amino acid sequence according to SEQ ID NO: 189; and a light chain variable region comprising an amino acid sequence having at least 96% sequence identity with an amino acid sequence according to SEQ ID NO: 199. In some embodiments, the TL1A binding protein comprises a heavy chain variable region comprising an amino acid sequence having at least 97% sequence identity with an amino acid sequence according to SEQ ID NO: 189; and a light chain variable region comprising an amino acid sequence having at least 97% sequence identity with an amino acid sequence according to SEQ ID NO: 199. In some embodiments, the TL1A binding protein comprises a heavy chain variable region comprising an amino acid sequence having at least 98% sequence identity with an amino acid sequence according to SEQ ID NO: 189; and a light chain variable region comprising an amino acid sequence having at least 98% sequence identity with an amino acid sequence according to SEQ ID NO: 199. In some embodiments, the TL1A binding protein comprises a heavy chain variable region comprising an amino acid sequence having at least 99% sequence identity with an amino acid sequence according to SEQ ID NO: 189; and a light chain variable region comprising an amino acid sequence having at least 99% sequence identity with an amino acid sequence according SEQ ID NO: 199. In some embodiments, the TL1A binding protein comprises a heavy chain variable region comprising an amino acid sequence according to SEQ ID NO: 189; and a light chain variable region comprising an amino acid sequence according to SEQ ID NO: 199.

In some embodiments, the TL1A binding protein comprises a heavy chain variable region comprising an amino acid sequence having at least 80% sequence identity with an amino acid sequence according to SEQ ID NO: 190; and a light chain variable region comprising an amino acid sequence having at least 80% sequence identity with an amino acid sequence according to SEQ ID NO: 200. In some embodiments, the TL1A binding protein comprises a heavy chain variable region comprising an amino acid sequence having at least 85% sequence identity with an amino acid sequence according to SEQ ID NO: 190; and a light chain variable region comprising an amino acid sequence having at least 85% sequence identity with an amino acid sequence according to SEQ ID NO: 200. In some embodiments, the TL1A binding protein comprises a heavy chain variable region comprising an amino acid sequence having at least 90% sequence identity with an amino acid sequence according to SEQ ID NO: 190; and a light chain variable region comprising an amino acid sequence having at least 90% sequence identity with an amino acid sequence according to SEQ ID NO: 200. In some embodiments, the TL1A binding protein comprises a heavy chain variable region comprising an amino acid sequence having at least 95% sequence identity with an amino acid sequence according to SEQ ID NO: 190; and a light chain variable region comprising an amino acid sequence having at least 95% sequence identity with an amino acid sequence according to SEQ ID NO: 200. In some embodiments, the TL1A binding protein comprises a heavy chain variable region comprising an amino acid sequence having at least 96% sequence identity with an amino acid sequence according to SEQ ID NO: 190; and a light chain variable region comprising an amino acid sequence having at least 96% sequence identity with an amino acid sequence according to SEQ ID NO: 200. In some embodiments, the TL1A binding protein comprises a heavy chain variable region comprising an amino acid sequence having at least 97% sequence identity with an amino acid sequence according to SEQ ID NO: 190; and a light chain variable region comprising an amino acid sequence having at least 97% sequence identity with an amino acid sequence according to SEQ ID NO: 200. In some embodiments, the TL1A binding protein comprises a heavy chain variable region comprising an amino acid sequence having at least 98% sequence identity with an amino acid sequence according to SEQ ID NO: 190; and a light chain variable region comprising an amino acid sequence having at least 98% sequence identity with an amino acid sequence according to SEQ ID NO: 200. In some embodiments, the TL1A binding protein comprises a heavy chain variable region comprising an amino acid sequence having at least 99% sequence identity with an amino acid sequence according to SEQ ID NO: 190; and a light chain variable region comprising an amino acid sequence having at least 99% sequence identity with an amino acid sequence according SEQ ID NO: 200. In some embodiments, the TL1A binding protein comprises a heavy chain variable region comprising an amino acid sequence according to SEQ ID NO: 190; and a light chain variable region comprising an amino acid sequence according to SEQ ID NO: 200.

In some embodiments, the TL1A binding protein binds TL1A with a $K_D$ lower than or equal to 10 nanomolar (nM), 9 nM, 8 nM, 7 nM, 6 nM, 5 nM, 4 nM, 3 nM, 2 nM. InM, 0.9 nM, 0.8 nM, 0.7 nM, 0.6 nM, 0.5 nM, 0.4 nM, 0.3 nM, 0.2 nM, 0.1 nM, 90 pM, 80 pM, 70 pM, 60 pM, 50 pM, 40 pM, 30 pM, 20 pM, or 10 pM. In some embodiments, the TL1A binding protein binds TL1A with a $K_D$ within the range of about 10 pM-about 1 nM, about 10 pM-about 0.9 nM, about 10 pM-about 0.8 nM, about 10 pM-about 0.7 nM, about 10 pM-about 0.6 nM, about 10 pM-about 0.5 nM, about 10 pM-about 0.4 nM, about 10 pM-about 0.3 nM, about 10 pM-about 0.2 nM, about 10 pM-about 0.1 nM, about 10 pM-about 50 pM, 0.1 nM-about 10 nM, about 0.1 nM-about 9 nM, about 0.1 nM-about 8 nM, about 0.1 nM-about 7 nM, about 0.1 nM-about 6 nM, about 0.1 nM-about 5 nM, about 0.1 nM-about 4 nM, about 0.1 nM-about 3 nM, about 0.1 nM-about 2 nM, about 0.1 nM-about 1 nM, or about 0.1 nM-about 0.5 nM. In some embodiments, the TL1A binding protein binds TL1A with a $K_D$ less than about 1 nanomolar (nM). In some embodiments, the TL1A binding protein binds TL1A with a $K_D$ less than about 0.9 nanomolar (nM). In some embodiments, the TL1A binding protein binds TL1A with a $K_D$ less than about 0.8 nanomolar (nM). In some embodiments, the TL1A binding protein binds TL1A with a $K_D$ less than about 0).7 nanomolar (nM). In some embodiments, the TL1A binding protein binds TL1A with a $K_D$ less than about 0.6 nanomolar (nM). In some embodiments, the TL1A binding protein binds TL1A with a $K_D$ less than about 0.5 nanomolar (nM). In some embodiments, the TL1A binding protein binds TL1A with a $K_D$ less than about 0.4 nanomolar (nM). In some embodiments, the TL1A binding protein binds TL1A with a $K_D$ less than about 0.3 nanomolar (nM). In some embodiments, the TL1A binding protein binds TL1A with a $K_D$ less than about 0.2 nanomolar (nM). In some embodiments, the TL1A binding protein binds TL1A with a $K_D$ less than about 0.1 nanomolar (nM). In some embodiments, the $K_D$ is measured by surface plasmon resonance (SPR). In some embodiments, the K is measured by Biolayer Interferometry (BLI).

In some embodiments, the TL1A binding protein comprises a binding affinity to TL1A at least 1.5 fold, 2 fold, 3 fold, 4 fold, 5 fold, 6 fold, 7 fold, 8 fold, 9 fold, 10 fold, 15 fold, or 20 fold more than a binding affinity of a comparator antibody to TL1A. In some embodiments, the TL1A binding protein comprises a binding affinity to TL1A at least 1.5 fold more than a binding affinity of a comparator antibody to TL1A. In some embodiments, the TL1A binding protein comprises a binding affinity to TL1A at least 2 fold more than a binding affinity of a comparator antibody to TL1A. In some embodiments, the TL1A binding protein comprises a binding affinity to TL1A at least 3 fold more than a binding affinity of a comparator antibody to TL1A. In some embodiments, the TL1A binding protein comprises a binding affinity to TL1A at least 4 fold more than a binding affinity of a comparator antibody to TL1A. In some embodiments, the TL1A binding protein comprises a binding affinity to TL1A at least 5 fold more than a binding affinity of a comparator antibody to TL1A. In some embodiments, the TL1A binding protein comprises a binding affinity to TL1A at least 6 fold more than a binding affinity of a comparator antibody to TL1A. In some embodiments, the TL1A binding protein comprises a binding affinity to TL1A at least 7 fold more than a binding affinity of a comparator antibody to TL1A. In some embodiments, the TL1A binding protein comprises a binding affinity to TL1A at least 8 fold more than a binding affinity of a comparator antibody to TL1A. In some embodiments, the TL1A binding protein comprises a binding affinity to TL1A at least 9 fold more than a binding affinity of a comparator antibody to TL1A. In some embodiments, the TL1A binding protein comprises a binding affinity to TL1A at least 10 fold more than a binding affinity of a comparator antibody to TL1A.

In some embodiments, the TL1A binding protein inhibits receptor (e.g., death receptor 3 (DR3) and decoy receptor 3 (DcR3)) binding to TL1A by at least 1.5 fold, 2 fold, 3 fold, 4 fold, 5 fold, 6 fold, 7 fold, 8 fold, 9 fold, 10 fold, 15 fold, or 20 fold more than a comparator antibody to TL1A. In some embodiments, the TL1A binding protein inhibits receptor binding to TL1A by at least 1.5 fold more than a comparator antibody to TL1A. In some embodiments, the TL1A binding protein inhibits receptor binding to TL1A by at least 2 fold more than a comparator antibody to TL1A. In some embodiments, the TL1A binding protein inhibits receptor binding to TL1A by at least 3 fold more than a comparator antibody to TL1A. In some embodiments, the TL1A binding protein inhibits receptor binding to TL1A by at least 4 fold more than a comparator antibody to TL1A. In some embodiments, the TL1A binding protein inhibits receptor binding to TL1A by at least 5 fold more than a comparator antibody to TL1A. In some embodiments, the TL1A binding protein inhibits receptor binding to TL1A by at least 6 fold more than a comparator antibody to TL1A. In some embodiments, the TL1A binding protein inhibits receptor binding to TL1A by at least 7 fold more than a comparator antibody to TL1A. In some embodiments, the TL1A binding protein inhibits receptor binding to TL1A by at least 8 fold more than a comparator antibody to TL1A. In some embodiments, the TL1A binding protein inhibits receptor binding to TL1A by at least 9 fold more than a comparator antibody to TL1A. In some embodiments, the TL1A binding protein inhibits receptor binding to TL1A by at least 10 fold more than a comparator antibody to TL1A.

In some embodiments, the TL1A binding protein reduces TL1A-induced apoptosis by at least 1.5 fold, 2 fold, 3 fold, 4 fold, 5 fold, 6 fold, 7 fold, 8 fold, 9 fold, 10 fold, 15 fold, or 20 fold more than a binding affinity of a comparator antibody to TL1A. In some embodiments, the TL1A binding protein reduces TL1A-induced apoptosis by at least 1.5 fold more than a binding affinity of a comparator antibody to TL1A. In some embodiments, the TL1A binding protein reduces TL1A-induced apoptosis by at least 2 fold more than a binding affinity of a comparator antibody to TL1A. In some embodiments, the TL1A binding protein reduces TL1A-induced apoptosis by at least 3 fold more than a binding affinity of a comparator antibody to TL1A. In some embodiments, the TL1A binding protein reduces TL1A-induced apoptosis by at least 4 fold more than a binding affinity of a comparator antibody to TL1A. In some embodiments, the TL1A binding protein reduces TL1A-induced apoptosis by at least 5 fold more than a binding affinity of a comparator antibody to TL1A. In some embodiments, the TL1A binding protein reduces TL1A-induced apoptosis by at least 6 fold more than a binding affinity of a comparator antibody to TL1A. In some embodiments, the TL1A binding protein reduces TL1A-induced apoptosis by at least 7 fold more than a binding affinity of a comparator antibody to TL1A. In some embodiments, the TL1A binding protein reduces TL1A-induced apoptosis by at least 8 fold more than a binding affinity of a comparator antibody to TL1A. In some embodiments, the TL1A binding protein reduces TL1A-induced apoptosis by at least 9 fold more than a binding affinity of a comparator antibody to TL1A. In some embodiments, the TL1A binding protein reduces TL1A-induced apoptosis by at least 10 fold more than a binding affinity of a comparator antibody to TL1A.

In some embodiments, the TL1A binding protein exhibits improved solubility and/or developability. In some embodiments, the TL1A binding protein is formulated at high concentrations. In some embodiments, the TL1A binding protein is formulated at high concentrations for subcutaneous administration (e.g., by an autoinjector). In some embodiments, the TL1A binding protein is formulated at a concentration of at least about 75, 100, 110, 120, 130, 140, 150, 160, 170, 180, 190, 200, 210, 220, 230, 240, 250, 260, 270, 280, 290, 300, or more than 300 milligrams per milliliter (mg/mL). In some embodiments, the TL1A binding protein is formulated at a concentration in a range of about 50 to about 300, about 50 to about 200, about 50 to about 150, about 50 to about 100, about 75 to about 300, about 75 to about 200, about 75 to about 150, about 75 to about 100, about 100 to about 200, about 100 to about 150, or about 150 to about 200 mg/mL.

In some embodiments, the TL1A binding protein is formulated a pH range from about 5 to about 7. In some embodiments, the TL1A binding protein is formulated a pH range from about 5.5 to about 6.5. In some embodiments, the TL1A binding protein is formulated a pH range of about 4, 4.5, 5, 5.5, 6, 6.5, 7, or 7.5. In some embodiments, the TL1A binding protein is formulated a pH range ranging from about 4-4.5, 4.5-5, 5-5.5, 5.5-6, 6-6.5, 6.5-7, or 7-7.5.

Fc Modifications

Provided herein are compositions, systems, and methods comprising a TL1A binding protein comprising a modified Fc region. Unless otherwise specified herein, numbering of amino acid residues in the Fc region or constant region is according to the EU numbering system, also called the EU index, as described in Kabat et al., Sequences of Proteins of Immunological Interest, 5th Ed. Public Health Service, National Institutes of Health, Bethesda, MD, 1991.

In some embodiments, the TL1A binding proteins comprise a modified Fc comprising one or more modifications. In some embodiments, the one or more modifications are located in a Fc from IgG1 (e.g., human IgG1 (hIgG1). In some embodiments, the one or more modifications are located in a Fc from IgG4 (e.g., human IgG4 (hIgG4). In some embodiments, the one or more modifications are located in a Fc from IgG2. In some embodiments, the one or more modifications promote selective binding of Fc-gamma receptors.

Amino acid sequences of exemplary Fc sequences are provided in Table 3.

TABLE 3

EXEMPLARY FC AMINO ACID SEQUENCES

| Name | SEQ ID NO | Fc Sequence |
|---|---|---|
| hIgG1 | 201 | ASTKGPSVFPLAPSSKSTSGGTAALGCLVKDYFPEPVTVSWNS<br>GALTSGVHTFPAVLQSSGLYSLSSVVTVPSSSLGTQTYICNVNH<br>KPSNTKVDKKVEPKSCDKTHTCPPCPAPELLGGPSVFLFPPKPK<br>DTLMISRTPEVTCVVVDVSHEDPEVKFNWYVDGVEVHNAKT<br>KPREEQYNSTYRVVSVLTVLHQDWLNGKEYKCKVSNKALPA<br>PIEKTISKAKGQPREPQVYTLPPSRDELTKNQVSLTCLVKGFYP<br>SDIAVEWESNGQPENNYKTTPPVLDSDGSFFLYSKLTVDKSRW<br>QQGNVFSCSVMHEALHNHYTQKSLSLSPG |
| hIgG4 | 202 | ASTKGPSVFPLAPCSRSTSESTAALGCLVKDYFPEPVTVSWNS<br>GALTSGVHTFPAVLQSSGLYSLSSVVTVPSSSLGTKTYTCNVD<br>HKPSNTKVDKRVESKYGPPCPSCPAPEFLGGPSVFLFPPKPKDT<br>LMISRTPEVTCVVVDVSQEDPEVQFNWYVDGVEVHNAKTKP<br>REEQFNSTYRVVSVLTVLHQDWLNGKEYKCKVSNKGLPSSIE<br>KTISKAKGQPREPQVYTLPPSQEEMTKNQVSLTCLVKGFYPSD<br>IAVEWESNGQPENNYKTTPPVLDSDGSFFLYSRLTVDKSRWQE<br>GNVFSCSVMHEALHNHYTQKSLSLSLGK |
| IgG2 | 203 | ASTKGPSVFPLAPCSRSTSESTAALGCLVKDYFPEPVTVSWNS<br>GALTSGVHTFPAVLQSSGLYSLSSVVTVPSSNFGTQTYTCNVD<br>HKPSNTKVDKTVERKCCVECPPCPAPPVAGPSVFLFPPKPKDT<br>LMISRTPEVTCVVVDVSHEDPEVQFNWYVDGVEVHNAKTKP<br>REEQFNSTFRVVSVLTVVHQDWLNGKEYKCKVSNKGLPAPIE<br>KTISKTKGQPREPQVYTLPPSREEMTKNQVSLTCLVKGFYPSDI<br>AVEWESNGQPENNYKTTPPMLDSDGSFFLYSKLTVDKSRWQQ<br>GNVFSCSVMHEALHNHYTQKSLSLSP |
| IgG4-SP | 204 | ASTKGPSVFPLAPCSRSTSESTAALGCLVKDYFPEPVTVSWNS<br>GALTSGVHTFPAVLQSSGLYSLSSVVTVPSSSLGTKTYTCNVD<br>HKPSNTKVDKRVESKYGPPCPPCPAPEFLGGPSVFLFPPKPKDT<br>LMISRTPEVTCVVVDVSQEDPEVQFNWYVDGVEVHNAKTKP<br>REEQFNSTYRVVSVLTVLHQDWLNGKEYKCKVSNKGLPSSIE<br>KTISKAKGQPREPQVYTLPPSQEEMTKNQVSLTCLVKGFYPSD<br>IAVEWESNGQPENNYKTTPPVLDSDGSFFLYSRLTVDKSRWQE<br>GNVFSCSVMHEALHNHYTQKSLSLSLGK |
| IgG4-SPLE | 205 | ASTKGPSVFPLAPCSRSTSESTAALGCLVKDYFPEPVTVSWNS<br>GALTSGVHTFPAVLQSSGLYSLSSVVTVPSSSLGTKTYTCNVD<br>HKPSNTKVDKRVESKYGPPCPPCPAPEELGGPSVFLFPPKPKDT<br>LMISRTPEVTCVVVDVSQEDPEVQFNWYVDGVEVHNAKTKP<br>REEQFNSTYRVVSVLTVLHQDWLNGKEYKCKVSNKGLPSSIE<br>KTISKAKGQPREPQVYTLPPSQEEMTKNQVSLTCLVKGFYPSD<br>IAVEWESNGQPENNYKTTPPVLDSDGSFFLYSRLTVDKSRWQE<br>GNVFSCSVMHEALHNHYTQKSLSLSLGK |
| hIgG1-<br>N297A | 206 | ASTKGPSVFPLAPSSKSTSGGTAALGCLVKDYFPEPVTVSWNS<br>GALTSGVHTFPAVLQSSGLYSLSSVVTVPSSSLGTQTYICNVNH<br>KPSNTKVDKKVEPKSCDKTHTCPPCPAPELLGGPSVFLFPPKPK<br>DTLMISRTPEVTCVVVDVSHEDPEVKFNWYVDGVEVHNAKT<br>KPREEQYASTYRVVSVLTVLHQDWLNGKEYKCKVSNKALPA<br>PIEKTISKAKGQPREPQVYTLPPSRDELTKNQVSLTCLVKGFYP<br>SDIAVEWESNGQPENNYKTTPPVLDSDGSFFLYSKLTVDKSRW<br>QQGNVFSCSVMHEALHNHYTQKSLSLSPG |

TABLE 3-continued

EXEMPLARY FC AMINO ACID SEQUENCES

| Name | SEQ ID NO | Fc Sequence |
|---|---|---|
| hIgG1-D265A | 207 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVAVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPG |
| hIgG1-LALA | 208 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPG |
| hIgG1-LAGA | 209 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPG |
| hIgG1-LALAGA | 210 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPG |
| hIgG1-LALAPG | 211 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVLHQDWLNGKEYKCKVSNKALG APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPG |
| hIgG1-YTE | 212 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLYITREPEVTCVVVDVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPG |
| hIgG1-N297A/YTE | 213 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLYITREPEVTCVVVDVSHEDPEVKFNWYVDGVEVHNAKT KPREEQYASTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPG |
| hIgG1-D265A/YTE | 214 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLYITREPEVTCVVVAVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPG |

TABLE 3-continued

EXEMPLARY FC AMINO ACID SEQUENCES

| Name | SEQ ID NO | Fc Sequence |
|---|---|---|
| hIgG1-LALA/YTE | 215 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLYITREPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPG |
| hIgG1-LAGA/YTE | 216 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLYITREPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPG |
| hIgG1-LALAGA/YTE | 217 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLYITREPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPG |
| hIgG1-LALAPG/YTE | 218 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLYITREPEVTCVVVDVSHEDPEVKFNWYVDGVEVHNAK TKPREEQYNSTYRVVSVLTVLHQDWLNGKEYKCKVSNKALG APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPG |
| hIgG1-LS | 219 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVLHEALHSHYTQKSLSLSPG |
| hIgG1-N297A/LS | 220 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYASTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVLHEALHSHYTQKSLSLSPG |
| hIgG1-D265A/LS | 221 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVAVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVLHEALHSHYTQKSLSLSPG |
| hIgG1-LALA/LS | 222 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHSHYTQKSLSLSPG |

TABLE 3-continued

EXEMPLARY FC AMINO ACID SEQUENCES

| Name | SEQ ID NO | Fc Sequence |
|---|---|---|
| hIgG1-LAGA/LS | 223 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHSHYTQKSLSLSPG |
| hIgG1-LALAGA/LS | 224 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHSHYTQKSLSLSPG |
| hIgG1-LALAPG/LS | 225 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVLHQDWLNGKEYKCKVSNKALG APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHSHYTQKSLSLSPG |
| hIgG1-DHS | 226 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYNSTYRVVSVLTVDHHDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHSHYTQKSLSLSPG |
| hIgG1-N297A/DHS | 227 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYASTYRVVSVLTVDHHDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHSHYTQKSLSLSPG |
| hIgG1-D265A/DHS | 228 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVAVSHEDPEVKFNWYVDGVEVHNAKT KPREEQYNSTYRVVSVLTVDHHDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHSHYTQKSLSLSPG |
| hIgG1-LALA/DHS | 229 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVDHHDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHSHYTQKSLSLSPG |
| hIgG1-LAGA/DHS | 230 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLMISRTPEVTCVVVDVSHEDPEVKFNWYVDGVEVHNAK TKPREEQYNSTYRVVSVLTVDHHDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHSHYTQKSLSLSPG |

TABLE 3-continued

EXEMPLARY FC AMINO ACID SEQUENCES

| Name | SEQ ID NO | Fc Sequence |
|---|---|---|
| hIgG1-LALAGA/DHS | 231 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLMISRTPEVTCVVVDVSHEDPEVKFNWYVDGVEVHNAK TKPREEQYNSTYRVVSVLTVDHHDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHSHYTQKSLSLSPG |
| hIgG1-LALAPG/DHS | 232 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVDHHDWLNGKEYKCKVSNKALG APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHSHYTQKSLSLSPG |
| hIgG4-YTE | 233 | ASTKGPSVFPLAPCSRSTSESTAALGCLVKDYFPEPVTVSWNS GALTSGVHTFPAVLQSSGLYSLSSVVTVPSSSLGTKTYTCNVD HKPSNTKVDKRVESKYGPPCPSCPAPEFLGGPSVFLFPPKPKDT LYITREPEVTCVVVDVSQEDPEVQFNWYVDGVEVHNAKTKPR EEQFNSTYRVVSVLTVLHQDWLNGKEYKCKVSNKGLPSSIEK TISKAKGQPREPQVYTLPPSQEEMTKNQVSLTCLVKGFYPSDI AVEWESNGQPENNYKTTPPVLDSDGSFFLYSRLTVDKSRWQE GNVFSCSVMHEALHNHYTQKSLSLSLGK |
| hIgG4-SP/YTE | 234 | ASTKGPSVFPLAPCSRSTSESTAALGCLVKDYFPEPVTVSWNS GALTSGVHTFPAVLQSSGLYSLSSVVTVPSSSLGTKTYTCNVD HKPSNTKVDKRVESKYGPPCPPCPAPEFLGGPSVFLFPPKPKDT LYITREPEVTCVVVDVSQEDPEVQFNWYVDGVEVHNAKTKPR EEQFNSTYRVVSVLTVLHQDWLNGKEYKCKVSNKGLPSSIEK TISKAKGQPREPQVYTLPPSQEEMTKNQVSLTCLVKGFYPSDI AVEWESNGQPENNYKTTPPVLDSDGSFFLYSRLTVDKSRWQE GNVFSCSVMHEALHNHYTQKSLSLSLGK |
| hIgG4-SPLE/YTE | 235 | ASTKGPSVFPLAPCSRSTSESTAALGCLVKDYFPEPVTVSWNS GALTSGVHTFPAVLQSSGLYSLSSVVTVPSSSLGTKTYTCNVD HKPSNTKVDKRVESKYGPPCPPCPAPEELGGPSVFLFPPKPKDT LYITREPEVTCVVVDVSQEDPEVQFNWYVDGVEVHNAKTKPR EEQFNSTYRVVSVLTVLHQDWLNGKEYKCKVSNKGLPSSIEK TISKAKGQPREPQVYTLPPSQEEMTKNQVSLTCLVKGFYPSDI AVEWESNGQPENNYKTTPPVLDSDGSFFLYSRLTVDKSRWQE GNVFSCSVMHEALHNHYTQKSLSLSLGK |
| hIgG4-LS | 236 | ASTKGPSVFPLAPCSRSTSESTAALGCLVKDYFPEPVTVSWNS GALTSGVHTFPAVLQSSGLYSLSSVVTVPSSSLGTKTYTCNVD HKPSNTKVDKRVESKYGPPCPSCPAPEFLGGPSVFLFPPKPKDT LMISRTPEVTCVVVDVSQEDPEVQFNWYVDGVEVHNAKTKP REEQFNSTYRVVSVLTVLHQDWLNGKEYKCKVSNKGLPSSIE KTISKAKGQPREPQVYTLPPSQEEMTKNQVSLTCLVKGFYPSD IAVEWESNGQPENNYKTTPPVLDSDGSFFLYSRLTVDKSRWQE GNVFSCSVLHEALHSYTQKSLSLSLGK |
| hIgG4-SP/LS | 237 | ASTKGPSVFPLAPCSRSTSESTAALGCLVKDYFPEPVTVSWNS GALTSGVHTFPAVLQSSGLYSLSSVVTVPSSSLGTKTYTCNVD HKPSNTKVDKRVESKYGPPCPPCPAPEFLGGPSVFLFPPKPKDT LMISRTPEVTCVVVDVSQEDPEVQFNWYVDGVEVHNAKTKP REEQFNSTYRVVSVLTVLHQDWLNGKEYKCKVSNKGLPSSIE KTISKAKGQPREPQVYTLPPSQEEMTKNQVSLTCLVKGFYPSD IAVEWESNGQPENNYKTTPPVLDSDGSFFLYSRLTVDKSRWQE GNVFSCSVLHEALHSHYTQKSLSLSLGK |
| hIgG4-SPLE/LS | 238 | ASTKGPSVFPLAPCSRSTSESTAALGCLVKDYFPEPVTVSWNS GALTSGVHTFPAVLQSSGLYSLSSVVTVPSSSLGTKTYTCNVD HKPSNTKVDKRVESKYGPPCPPCPAPEELGGPSVFLFPPKPKDT LMISRTPEVTCVVVDVSQEDPEVQFNWYVDGVEVHNAKTKP REEQFNSTYRVVSVLTVLHQDWLNGKEYKCKVSNKGLPSSIE KTISKAKGQPREPQVYTLPPSQEEMTKNQVSLTCLVKGFYPSD IAVEWESNGQPENNYKTTPPVLDSDGSFFLYSRLTVDKSRWQE GNVFSCSVLHEALHSHYTQKSLSLSLGK |

TABLE 3-continued

EXEMPLARY FC AMINO ACID SEQUENCES

| Name | SEQ ID NO | Fc Sequence |
|---|---|---|
| hIgG4-DHS | 239 | ASTKGPSVFPLAPCSRSTSESTAALGCLVKDYFPEPVTVSWNS GALTSGVHTFPAVLQSSGLYSLSSVVTVPSSSLGTKTYTCNVD HKPSNTKVDKRVESKYGPPCPSCPAPEFLGGPSVFLFPPKPKDT LMISRTPEVTCVVVDVSQEDPEVQFNWYVDGVEVHNAKTKP REEQFNSTYRVVSVLTVDHHDWLNGKEYKCKVSNKGLPSSIE KTISKAKGQPREPQVYTLPPSQEEMTKNQVSLTCLVKGFYPSD IAVEWESNGQPENNYKTTPPVLDSDGSFFLYSRLTVDKSRWQE GNVFSCSVMHEALHSHYTQKSLSLSLGK |
| hIgG4-SP/DHS | 240 | ASTKGPSVFPLAPCSRSTSESTAALGCLVKDYFPEPVTVSWNS GALTSGVHTFPAVLQSSGLYSLSSVVTVPSSSLGTKTYTCNVD HKPSNTKVDKRVESKYGPPCPPCPAPEFLGGPSVFLFPPKPKDT LMISRTPEVTCVVVDVSQEDPEVQFNWYVDGVEVHNAKTKP REEQFNSTYRVVSVLTVDHHDWLNGKEYKCKVSNKGLPSSIE KTISKAKGQPREPQVYTLPPSQEEMTKNQVSLTCLVKGFYPSD IAVEWESNGQPENNYKTTPPVLDSDGSFFLYSRLTVDKSRWQE GNVFSCSVMHEALHSHYTQKSLSLSLGK |
| hIgG4-SPLE/DHS | 241 | ASTKGPSVFPLAPCSRSTSESTAALGCLVKDYFPEPVTVSWNS GALTSGVHTFPAVLQSSGLYSLSSVVTVPSSSLGTKTYTCNVD HKPSNTKVDKRVESKYGPPCPPCPAPEELGGPSVFLFPPKPKDT LMISRTPEVTCVVVDVSQEDPEVQFNWYVDGVEVHNAKTKP REEQFNSTYRVVSVLTVDHHDWLNGKEYKCKVSNKGLPSSIE KTISKAKGQPREPQVYTLPPSQEEMTKNQVSLTCLVKGFYPSD IAVEWESNGQPENNYKTTPPVLDSDGSFFLYSRLTVDKSRWQE GNVFSCSVMHEALHSHYTQKSLSLSLGK |
| hIgG2-YTE | 242 | ASTKGPSVFPLAPCSRSTSESTAALGCLVKDYFPEPVTVSWNS GALTSGVHTFPAVLQSSGLYSLSSVVTVPSSNFGTQTYTCNVD HKPSNTKVDKTVERKCCVECPPCPAPPVAGPSVFLFPPKPKDT LYITREPEVTCVVVDVSHEDPEVQFNWYVDGVEVHNAKTKPR EEQFNSTFRVVSVLTVVHQDWLNGKEYKCKVSNKGLPAPIEK TISKTKGQPREPQVYTLPPSREEMTKNQVSLTCLVKGFYPSDIA VEWESNGQPENNYKTTPPMLDSDGSFFLYSKLTVDKSRWQQG NVFSCSVLHEALHSHYTQKSLSLSP |
| hIgG2-LS | 243 | ASTKGPSVFPLAPCSRSTSESTAALGCLVKDYFPEPVTVSWNS GALTSGVHTFPAVLQSSGLYSLSSVVTVPSSNFGTQTYTCNVD HKPSNTKVDKTVERKCCVECPPCPAPPVAGPSVFLFPPKPKDT LMISRTPEVTCVVVDVSHEDPEVQFNWYVDGVEVHNAKTKP REEQFNSTFRVVSVLTVVHQDWLNGKEYKCKVSNKGLPAPIE KTISKTKGQPREPQVYTLPPSREEMTKNQVSLTCLVKGFYPSDI AVEWESNGQPENNYKTTPPMLDSDGSFFLYSKLTVDKSRWQQ GNVFSCSVMHEALHNHYTQKSLSLSP |
| hIgG2-DHS | 244 | ASTKGPSVFPLAPCSRSTSESTAALGCLVKDYFPEPVTVSWNS GALTSGVHTFPAVLQSSGLYSLSSVVTVPSSNFGTQTYTCNVD HKPSNTKVDKTVERKCCVECPPCPAPPVAGPSVFLFPPKPKDT LMISRTPEVTCVVVDVSHEDPEVQFNWYVDGVEVHNAKTKP REEQFNSTFRVVSVLTVDHHDWLNGKEYKCKVSNKGLPAPIE KTISKTKGQPREPQVYTLPPSREEMTKNQVSLTCLVKGFYPSDI AVEWESNGQPENNYKTTPPMLDSDGSFFLYSKLTVDKSRWQQ GNVFSCSVMHEALHSHYTQKSLSLSP |
| IgG4-SP | 245 | ASTKGPSVFPLAPCSRSTSESTAALGCLVKDYFPEPVTVSWNS GALTSGVHTFPAVLQSSGLYSLSSVVTVPSSSLGTKTYTCNVD HKPSNTKVDKRVESKYGPPCPPCPAPEFLGGPSVFLFPPKPKDT LMISRTPEVTCVVVDVSQEDPEVQFNWYVDGVEVHNAKTKP REEQFNSTYRVVSVLTVLHQDWLNGKEYKCKVSNKGLPSSIE KTISKAKGQPREPQVYTLPPSQEEMTKNQVSLTCLVKGFYPSD IAVEWESNGQPENNYKTTPPVLDSDGSFFLYSRLTVDKSRWQE GNVFSCSVMHEALHNHYTQKSLSLSLGK |
| hIgG1-LA | 246 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVLHEALHAHYTQKSLSLSPG |

TABLE 3-continued

EXEMPLARY FC AMINO ACID SEQUENCES

| Name | SEQ ID NO | Fc Sequence |
|---|---|---|
| hIgG1-N297A/LA | 247 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYASTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVLHEALHAHYTQKSLSLSPG |
| hIgG1-D265A/LA | 248 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVAVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVLHEALHAHYTQKSLSLSPG |
| hIgG1-LALA/LA | 249 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHAHYTQKSLSLSPG |
| hIgG1-LAGA/LA | 250 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHAHYTQKSLSLSPG |
| hIgG1-LALAGA/LA | 251 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHAHYTQKSLSLSPG |
| hIgG1-LALAPG/LA | 252 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVLHQDWLNGKEYKCKVSNKALG APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHAHYTQKSLSLSPG |
| hIgG1-N434A | 253 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHAHYTQKSLSLSPG |
| hIgG1-N297A/N434A | 254 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYASTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHAHYTQKSLSLSPG |

TABLE 3-continued

| EXEMPLARY FC AMINO ACID SEQUENCES | | |
|---|---|---|
| Name | SEQ ID NO | Fc Sequence |
| hIgG1-<br>D265A/<br>N434A | 255 | ASTKGPSVFPLAPSSKSTSGGTAALGCLVKDYFPEPVTVSWNS<br>GALTSGVHTFPAVLQSSGLYSLSSVVTVPSSSLGTQTYICNVNH<br>KPSNTKVDKKVEPKSCDKTHTCPPCPAPELLGGPSVFLFPPKPK<br>DTLMISRTPEVTCVVVAVSHEDPEVKFNWYVDGVEVHNAKT<br>KPREEQYNSTYRVVSVLTVLHQDWLNGKEYKCKVSNKALPA<br>PIEKTISKAKGQPREPQVYTLPPSRDELTKNQVSLTCLVKGFYP<br>SDIAVEWESNGQPENNYKTTPPVLDSDGSFFLYSKLTVDKSRW<br>QQGNVFSCSVMHEALHAHYTQKSLSLSPG |
| hIgG1-<br>LALA/<br>N434A | 256 | ASTKGPSVFPLAPSSKSTSGGTAALGCLVKDYFPEPVTVSWNS<br>GALTSGVHTFPAVLQSSGLYSLSSVVTVPSSSLGTQTYICNVNH<br>KPSNTKVDKKVEPKSCDKTHTCPPCPAPEAAGGPSVFLFPPKP<br>KDTLMISRTPEVTCVVVDVSHEDPEVKFNWYVDGVEVHNAK<br>TKPREEQYNSTYRVVSVLTVLHQDWLNGKEYKCKVSNKALP<br>APIEKTISKAKGQPREPQVYTLPPSRDELTKNQVSLTCLVKGFY<br>PSDIAVEWESNGQPENNYKTTPPVLDSDGSFFLYSKLTVDKSR<br>WQQGNVFSCSVMHEALHAHYTQKSLSLSPG |
| hIgG1-<br>LAGA/<br>N434A | 257 | ASTKGPSVFPLAPSSKSTSGGTAALGCLVKDYFPEPVTVSWNS<br>GALTSGVHTFPAVLQSSGLYSLSSVVTVPSSSLGTQTYICNVNH<br>KPSNTKVDKKVEPKSCDKTHTCPPCPAPELAGAPSVFLFPPKP<br>KDTLMISRTPEVTCVVVDVSHEDPEVKFNWYVDGVEVHNAK<br>TKPREEQYNSTYRVVSVLTVLHQDWLNGKEYKCKVSNKALP<br>APIEKTISKAKGQPREPQVYTLPPSRDELTKNQVSLTCLVKGFY<br>PSDIAVEWESNGQPENNYKTTPPVLDSDGSFFLYSKLTVDKSR<br>WQQGNVFSCSVMHEALHAHYTQKSLSLSPG |
| hIgG1-<br>LALAGA/<br>N434A | 258 | ASTKGPSVFPLAPSSKSTSGGTAALGCLVKDYFPEPVTVSWNS<br>GALTSGVHTFPAVLQSSGLYSLSSVVTVPSSSLGTQTYICNVNH<br>KPSNTKVDKKVEPKSCDKTHTCPPCPAPEAAGAPSVFLFPPKP<br>KDTLMISRTPEVTCVVVDVSHEDPEVKFNWYVDGVEVHNAK<br>TKPREEQYNSTYRVVSVLTVLHQDWLNGKEYKCKVSNKALP<br>APIEKTISKAKGQPREPQVYTLPPSRDELTKNQVSLTCLVKGFY<br>PSDIAVEWESNGQPENNYKTTPPVLDSDGSFFLYSKLTVDKSR<br>WQQGNVFSCSVMHEALHAHYTQKSLSLSPG |
| hIgG1-<br>LALAPG/<br>N434A | 259 | ASTKGPSVFPLAPSSKSTSGGTAALGCLVKDYFPEPVTVSWNS<br>GALTSGVHTFPAVLQSSGLYSLSSVVTVPSSSLGTQTYICNVNH<br>KPSNTKVDKKVEPKSCDKTHTCPPCPAPEAAGGPSVFLFPPKP<br>KDTLMISRTPEVTCVVVDVSHEDPEVKFNWYVDGVEVHNAK<br>TKPREEQYNSTYRVVSVLTVLHQDWLNGKEYKCKVSNKALG<br>APIEKTISKAKGQPREPQVYTLPPSRDELTKNQVSLTCLVKGFY<br>PSDIAVEWESNGQPENNYKTTPPVLDSDGSFFLYSKLTVDKSR<br>WQQGNVFSCSVMHEALHAHYTQKSLSLSPG |
| hIgG1-<br>N434W | 260 | ASTKGPSVFPLAPSSKSTSGGTAALGCLVKDYFPEPVTVSWNS<br>GALTSGVHTFPAVLQSSGLYSLSSVVTVPSSSLGTQTYICNVNH<br>KPSNTKVDKKVEPKSCDKTHTCPPCPAPELLGGPSVFLFPPKPK<br>DTLMISRTPEVTCVVVDVSHEDPEVKFNWYVDGVEVHNAKT<br>KPREEQYNSTYRVVSVLTVLHQDWLNGKEYKCKVSNKALPA<br>PIEKTISKAKGQPREPQVYTLPPSRDELTKNQVSLTCLVKGFYP<br>SDIAVEWESNGQPENNYKTTPPVLDSDGSFFLYSKLTVDKSRW<br>QQGNVFSCSVMHEALHWHYTQKSLSLSPG |
| hIgG1-<br>N297A/<br>N434W | 261 | ASTKGPSVFPLAPSSKSTSGGTAALGCLVKDYFPEPVTVSWNS<br>GALTSGVHTFPAVLQSSGLYSLSSVVTVPSSSLGTQTYICNVNH<br>KPSNTKVDKKVEPKSCDKTHTCPPCPAPELLGGPSVFLFPPKPK<br>DTLMISRTPEVTCVVVDVSHEDPEVKFNWYVDGVEVHNAKT<br>KPREEQYASTYRVVSVLTVLHQDWLNGKEYKCKVSNKALPA<br>PIEKTISKAKGQPREPQVYTLPPSRDELTKNQVSLTCLVKGFYP<br>SDIAVEWESNGQPENNYKTTPPVLDSDGSFFLYSKLTVDKSRW<br>QQGNVFSCSVMHEALHWHYTQKSLSLSPG |
| hIgG1-<br>D265A/<br>N434W | 262 | ASTKGPSVFPLAPSSKSTSGGTAALGCLVKDYFPEPVTVSWNS<br>GALTSGVHTFPAVLQSSGLYSLSSVVTVPSSSLGTQTYICNVNH<br>KPSNTKVDKKVEPKSCDKTHTCPPCPAPELLGGPSVFLFPPKPK<br>DTLMISRTPEVTCVVVAVSHEDPEVKFNWYVDGVEVHNAKT<br>KPREEQYNSTYRVVSVLTVLHQDWLNGKEYKCKVSNKALPA<br>PIEKTISKAKGQPREPQVYTLPPSRDELTKNQVSLTCLVKGFYP<br>SDIAVEWESNGQPENNYKTTPPVLDSDGSFFLYSKLTVDKSRW<br>QQGNVFSCSVMHEALHWHYTQKSLSLSPG |

TABLE 3-continued

EXEMPLARY FC AMINO ACID SEQUENCES

| Name | SEQ ID NO | Fc Sequence |
|---|---|---|
| hIgG1-LALA/N434W | 263 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHWHYTQKSLSLSPG |
| hIgG1-LAGA/N434W | 264 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHWHYTQKSLSLSPG |
| hIgG1-LALAGA/N434W | 265 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHWHYTQKSLSLSPG |
| hIgG1-LALAPG/N434W | 266 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVLHQDWLNGKEYKCKVSNKALG APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHWHYTQKSLSLSPG |
| hIgG1/DQ | 267 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRDPEVTCVVVDVSHEDPEVKFNWYVDGVEVHNAKT KPREEQYNSTYRVVSVLQVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPG |
| hIgG1-N297A/DQ | 268 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRDPEVTCVVVDVSHEDPEVKFNWYVDGVEVHNAKT KPREEQYASTYRVVSVLQVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPG |
| hIgG1-D265A/DQ | 269 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRDPEVTCVVVAVSHEDPEVKFNWYVDGVEVHNAKT KPREEQYNSTYRVVSVLQVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPG |
| hIgG1-LALA/DQ | 270 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRDPEVTCVVVDVSHEDPEVKFNWYVDGVEVHNAK TKPREEQYNSTYRVVSVLQVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPG |

TABLE 3-continued

EXEMPLARY FC AMINO ACID SEQUENCES

| Name | SEQ ID NO | Fc Sequence |
| --- | --- | --- |
| hIgG1-LAGA/DQ | 271 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLMISRDPEVTCVVVDVSHEDPEVKFNWYVDGVEVHNAK TKPREEQYNSTYRVVSVLQVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPG |
| hIgG1-LALAGA/DQ | 272 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLMISRDPEVTCVVVDVSHEDPEVKFNWYVDGVEVHNAK TKPREEQYNSTYRVVSVLQVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPG |
| hIgG1-LALAPG/DQ | 273 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRDPEVTCVVVDVSHEDPEVKFNWYVDGVEVHNAK TKPREEQYNSTYRVVSVLQVLHQDWLNGKEYKCKVSNKALG APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPG |
| hIgG1/DW | 274 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRDPEVTCVVVDVSHEDPEVKFNWYVDGVEVHNAKT KPREEQYNSTYRVVSVLWVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPG |
| hIgG1-N297A/DW | 275 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRDPEVTCVVVDVSHEDPEVKFNWYVDGVEVHNAKT KPREEQYASTYRVVSVLWVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPG |
| hIgG1-D265A/DW | 276 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRDPEVTCVVVAVSHEDPEVKFNWYVDGVEVHNAKT KPREEQYNSTYRVVSVLWVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPG |
| hIgG1-LALA/DW | 277 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRDPEVTCVVVDVSHEDPEVKFNWYVDGVEVHNAK TKPREEQYNSTYRVVSVLWVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPG |
| hIgG1-LAGA/DW | 278 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLMISRDPEVTCVVVDVSHEDPEVKFNWYVDGVEVHNAK TKPREEQYNSTYRVVSVLWVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPG |

TABLE 3-continued

EXEMPLARY FC AMINO ACID SEQUENCES

| Name | SEQ ID NO | Fc Sequence |
|---|---|---|
| hIgG1-LALAGA/DW | 279 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLMISRDPEVTCVVVDVSHEDPEVKFNWYVDGVEVHNAK TKPREEQYNSTYRVVSVLWVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPG |
| hIgG1-LALAPG/DW | 280 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRDPEVTCVVVDVSHEDPEVKFNWYVDGVEVHNAK TKPREEQYNSTYRVVSVLWVLHQDWLNGKEYKCKVSNKALG APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPG |
| hIgG1/YD | 281 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLYISRDPEVTCVVVDVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPG |
| hIgG1-N297A/YD | 282 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLYISRDPEVTCVVVDVSHEDPEVKFNWYVDGVEVHNAKT KPREEQYASTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPG |
| hIgG1-D265A/YD | 283 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLYISRDPEVTCVVVAVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPG |
| hIgG1-LALA/YD | 284 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLYISRDPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPG |
| hIgG1-LAGA/YD | 285 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLYISRDPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPG |
| hIgG1-LALAGA/YD | 286 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLYISRDPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPG |

TABLE 3-continued

| EXEMPLARY FC AMINO ACID SEQUENCES | | |
|---|---|---|
| Name | SEQ ID NO | Fc Sequence |
| hIgG1-LALAPG/YD | 287 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLYISRDPEVTCVVVDVSHEDPEVKFNWYVDGVEVHNAK TKPREEQYNSTYRVVSVLTVLHQDWLNGKEYKCKVSNKALG APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPG |
| hIgG1/QVV | 288 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYNSTYRVVSVLQVLHVDWLNGKEYKCKVSNKALPA PIEKTISKAKGQPREPQVYTLPPSRDELTKNQVSLTCLVKGFYP SDIVVEWESNGQPENNYKTTPPVLDSDGSFFLYSKLTVDKSRW QQGNVFSCSVMHEALHNHYTQKSLSLSPG |
| hIgG1-N297A/QVV | 289 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYASTYRVVSVLQVLHVDWLNGKEYKCKVSNKALPA PIEKTISKAKGQPREPQVYTLPPSRDELTKNQVSLTCLVKGFYP SDIVVEWESNGQPENNYKTTPPVLDSDGSFFLYSKLTVDKSRW QQGNVFSCSVMHEALHNHYTQKSLSLSPG |
| hIgG1-D265A/QVV | 290 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVAVSHEDPEVKFNWYVDGVEVHNAKT KPREEQYNSTYRVVSVLQVLHVDWLNGKEYKCKVSNKALPA PIEKTISKAKGQPREPQVYTLPPSRDELTKNQVSLTCLVKGFYP SDIVVEWESNGQPENNYKTTPPVLDSDGSFFLYSKLTVDKSRW QQGNVFSCSVMHEALHNHYTQKSLSLSPG |
| hIgG1-LALA/QVV | 291 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLQVLHVDWLNGKEYKCKVSNKALP APIEKTISKAKGQPREPQVYTLPPSRDELTKNQVSLTCLVKGFY PSDIVVEWESNGQPENNYKTTPPVLDSDGSFFLYSKLTVDKSR WQQGNVFSCSVMHEALHNHYTQKSLSLSPG |
| hIgG1-LAGA/QVV | 292 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLMISRTPEVTCVVVDVSHEDPEVKFNWYVDGVEVHNAK TKPREEQYNSTYRVVSVLQVLHVDWLNGKEYKCKVSNKALP APIEKTISKAKGQPREPQVYTLPPSRDELTKNQVSLTCLVKGFY PSDIVVEWESNGQPENNYKTTPPVLDSDGSFFLYSKLTVDKSR WQQGNVFSCSVMHEALHNHYTQKSLSLSPG |
| hIgG1-LALAGA/QVV | 293 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLMISRTPEVTCVVVDVSHEDPEVKFNWYVDGVEVHNAK TKPREEQYNSTYRVVSVLQVLHVDWLNGKEYKCKVSNKALP APIEKTISKAKGQPREPQVYTLPPSRDELTKNQVSLTCLVKGFY PSDIVVEWESNGQPENNYKTTPPVLDSDGSFFLYSKLTVDKSR WQQGNVFSCSVMHEALHNHYTQKSLSLSPG |
| hIgG1-LALAPG/QVV | 294 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLQVLHVDWLNGKEYKCKVSNKALG APIEKTISKAKGQPREPQVYTLPPSRDELTKNQVSLTCLVKGFY PSDIVVEWESNGQPENNYKTTPPVLDSDGSFFLYSKLTVDKSR WQQGNVFSCSVMHEALHNHYTQKSLSLSPG |

TABLE 3-continued

| EXEMPLARY FC AMINO ACID SEQUENCES | | |
|---|---|---|
| Name | SEQ ID NO | Fc Sequence |
| hIgG1/DDRVV | 295 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRDPEVTCVVVDVSHEDPEVKFNWYVDGVEVDNAKT KPREEQYNSTYRVVSVLRVLHVDWLNGKEYKCKVSNKALPA PIEKTISKAKGQPREPQVYTLPPSRDELTKNQVSLTCLVKGFYP SDIVVEWESNGQPENNYKTTPPVLDSDGSFFLYSKLTVDKSRW QQGNVFSCSVMHEALHNHYTQKSLSLSPG |
| hIgG1-N297A/DDRVV | 296 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRDPEVTCVVVDVSHEDPEVKFNWYVDGVEVDNAKT KPREEQYASTYRVVSVLRVLHVDWLNGKEYKCKVSNKALPA PIEKTISKAKGQPREPQVYTLPPSRDELTKNQVSLTCLVKGFYP SDIVVEWESNGQPENNYKTTPPVLDSDGSFFLYSKLTVDKSRW QQGNVFSCSVMHEALHNHYTQKSLSLSPG |
| hIgG1-D265A/DDRVV | 297 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRDPEVTCVVVAVSHEDPEVKFNWYVDGVEVDNAKT KPREEQYNSTYRVVSVLRVLHVDWLNGKEYKCKVSNKALPA PIEKTISKAKGQPREPQVYTLPPSRDELTKNQVSLTCLVKGFYP SDIVVEWESNGQPENNYKTTPPVLDSDGSFFLYSKLTVDKSRW QQGNVFSCSVMHEALHNHYTQKSLSLSPG |
| hIgG1-LALA/DDRVV | 298 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRDPEVTCVVVDVSHEDPEVKFNWYVDGVEVDNAK TKPREEQYNSTYRVVSVLRVLHVDWLNGKEYKCKVSNKALP APIEKTISKAKGQPREPQVYTLPPSRDELTKNQVSLTCLVKGFY PSDIVVEWESNGQPENNYKTTPPVLDSDGSFFLYSKLTVDKSR WQQGNVFSCSVMHEALHNHYTQKSLSLSPG |
| hIgG1-LAGA/DDRVV | 299 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLMISRDPEVTCVVVDVSHEDPEVKFNWYVDGVEVDNAK TKPREEQYNSTYRVVSVLRVLHVDWLNGKEYKCKVSNKALP APIEKTISKAKGQPREPQVYTLPPSRDELTKNQVSLTCLVKGFY PSDIVVEWESNGQPENNYKTTPPVLDSDGSFFLYSKLTVDKSR WQQGNVFSCSVMHEALHNHYTQKSLSLSPG |
| hIgG1-LALAGA/DDRVV | 300 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLMISRDPEVTCVVVDVSHEDPEVKFNWYVDGVEVDNAK TKPREEQYNSTYRVVSVLRVLHVDWLNGKEYKCKVSNKALP APIEKTISKAKGQPREPQVYTLPPSRDELTKNQVSLTCLVKGFY PSDIVVEWESNGQPENNYKTTPPVLDSDGSFFLYSKLTVDKSR WQQGNVFSCSVMHEALHNHYTQKSLSLSPG |
| hIgG1-LALAPG/DDRVV | 301 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRDPEVTCVVVDVSHEDPEVKFNWYVDGVEVDNAK TKPREEQYNSTYRVVSVLRVLHVDWLNGKEYKCKVSNKALG APIEKTISKAKGQPREPQVYTLPPSRDELTKNQVSLTCLVKGFY PSDIVVEWESNGQPENNYKTTPPVLDSDGSFFLYSKLTVDKSR WQQGNVFSCSVMHEALHNHYTQKSLSLSPG |
| hIgG1-Q311R/M428L | 302 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYNSTYRVVSVLTVLHRDWLNGKEYKCKVSNKALPA |

TABLE 3-continued

EXEMPLARY FC AMINO ACID SEQUENCES

| Name | SEQ ID NO | Fc Sequence |
|---|---|---|
| | | PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVLHEALHNHYTQKSLSLSPG |
| hIgG4-Q311R/M428L | 303 | ASTKGPSVFPLAPCSRSTSESTAALGCLVKDYFPEPVTVSWNS GALTSGVHTFPAVLQSSGLYSLSSVVTVPSSSLGTKTYTCNVD HKPSNTKVDKRVESKYGPPCPSCPAPEFLGGPSVFLFPPKPKDT LMISRTPEVTCVVVDVSQEDPEVQFNWYVDGVEVHNAKTKP REEQFNSTYRVVSVLTVLHRDWLNGKEYKCKVSNKGLPSSIE KTISKAKGQPREPQVYTLPPSQEEMTKNQVSLTCLVKGFYPSD IAVEWESNGQPENNYKTTPPVLDSDGSFFLYSRLTVDKSRWQE GNVFSCSVLHEALHNHYTQKSLSLSLGK |
| IgG4-SP/Q311R/M428L | 304 | ASTKGPSVFPLAPCSRSTSESTAALGCLVKDYFPEPVTVSWNS GALTSGVHTFPAVLQSSGLYSLSSVVTVPSSSLGTKTYTCNVD HKPSNTKVDKRVESKYGPPCPPCPAPEFLGGPSVFLFPPKPKDT LMISRTPEVTCVVVDVSQEDPEVQFNWYVDGVEVHNAKTKP REEQFNSTYRVVSVLTVLHRDWLNGKEYKCKVSNKGLPSSIE KTISKAKGQPREPQVYTLPPSQEEMTKNQVSLTCLVKGFYPSD IAVEWESNGQPENNYKTTPPVLDSDGSFFLYSRLTVDKSRWQE GNVFSCSVLHEALHNHYTQKSLSLSLGK |
| IgG4-SPLE/Q311R/M428L | 305 | ASTKGPSVFPLAPCSRSTSESTAALGCLVKDYFPEPVTVSWNS GALTSGVHTFPAVLQSSGLYSLSSVVTVPSSSLGTKTYTCNVD HKPSNTKVDKRVESKYGPPCPPCPAPEELGGPSVFLFPPKPKDT LMISRTPEVTCVVVDVSQEDPEVQFNWYVDGVEVHNAKTKP REEQFNSTYRVVSVLTVLHRDWLNGKEYKCKVSNKGLPSSIE KTISKAKGQPREPQVYTLPPSQEEMTKNQVSLTCLVKGFYPSD IAVEWESNGQPENNYKTTPPVLDSDGSFFLYSRLTVDKSRWQE GNVFSCSVLHEALHNHYTQKSLSLSLGK |
| IgG2-Q311R/M428L | 306 | ASTKGPSVFPLAPCSRSTSESTAALGCLVKDYFPEPVTVSWNS GALTSGVHTFPAVLQSSGLYSLSSVVTVPSSNFGTQTYTCNVD HKPSNTKVDKTVERKCCVECPPCPAPPVAGPSVFLFPPKPKDT LMISRTPEVTCVVVDVSHEDPEVQFNWYVDGVEVHNAKTKP REEQFNSTFRVVSVLTVVHRDWLNGKEYKCKVSNKGLPAPIE KTISKTKGQPREPQVYTLPPSREEMTKNQVSLTCLVKGFYPSDI AVEWESNGQPENNYKTTPPMLDSDGSFFLYSKLTVDKSRWQQ GNVFSCSVLHEALHNHYTQKSLSLSP |
| hIgG1-N297A/Q311R/M428L | 307 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYASTYRVVSVLTVLHRDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVLHEALHNHYTQKSLSLSPG |
| hIgG1-D265A/Q311R/M428L | 308 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVAVSHEDPEVKFNWYVDGVEVHNAKT KPREEQYNSTYRVVSVLTVLHRDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVLHEALHNHYTQKSLSLSPG |
| hIgG1-LALA/Q311R/M428L | 309 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVLHRDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHNHYTQKSLSLSPG |
| hIgG1-LAGA/Q311R/M428L | 310 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLMISRTPEVTCVVVDVSHEDPEVKFNWYVDGVEVHNAK TKPREEQYNSTYRVVSVLTVLHRDWLNGKEYKCKVSNKALP |

TABLE 3-continued

EXEMPLARY FC AMINO ACID SEQUENCES

| Name | SEQ ID NO | Fc Sequence |
| --- | --- | --- |
| | | APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHNHYTQKSLSLSPG |
| hIgG1-LALAGA/ Q311R/M428L | 311 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLMISRTPEVTCVVVDVSHEDPEVKFNWYVDGVEVHNAK TKPREEQYNSTYRVVSVLTVLHRDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHNHYTQKSLSLSPG |
| hIgG1-LALAPG/ Q311R/M428L | 312 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVLHRDWLNGKEYKCKVSNKALG APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHNHYTQKSLSLSPG |
| hIgG1 (with C-terminal lysine) | 2495 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPGK |
| hIgG1 (with C-terminal lysine)-N297A | 2496 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYASTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPGK |
| hIgG1 (with C-terminal lysine)-D265A | 2497 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVAVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPGK |
| hIgG1 (with C-terminal lysine)-LALA | 2498 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPGK |
| hIgG1 (with C-terminal lysine)-LAGA | 2499 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPGK |
| hIgG1 (with C-terminal lysine)-LALAGA | 2500 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLMISRTPEVTCVVVDVSHEDPEVKFNWYVDGVEVHNAK TKPREEQYNSTYRVVSVLTVLHQDWLNGKEYKCKVSNKALP |

TABLE 3-continued

EXEMPLARY FC AMINO ACID SEQUENCES

| Name | SEQ ID NO | Fc Sequence |
|---|---|---|
| | | APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPGK |
| hIgG1 (with C-terminal lysine)-LALAPG | 2501 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVLHQDWLNGKEYKCKVSNKALG APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPGK |
| hIgG1 (with C-terminal lysine)-YTE | 2502 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLYITREPEVTCVVVDVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPGK |
| hIgG1 (with C-terminal lysine)-N297A/YTE | 2503 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLYITREPEVTCVVVDVSHEDPEVKFNWYVDGVEVHNAKT KPREEQYASTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPGK |
| hIgG1 (with C-terminal lysine)-D265A/YTE | 2504 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLYITREPEVTCVVVAVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPGK |
| hIgG1 (with C-terminal lysine)-LALA/YTE | 2505 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLYITREPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPGK |
| hIgG1 (with C-terminal lysine)-LAGA/YTE | 2506 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLYITREPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPGK |
| hIgG1 (with C-terminal lysine)-LALAGA/YTE | 2507 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLYITREPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPGK |
| hIgG1 (with C-terminal lysine)-LALAPG/YTE | 2508 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLYITREPEVTCVVVDVSHEDPEVKFNWYVDGVEVHNAK TKPREEQYNSTYRVVSVLTVLHQDWLNGKEYKCKVSNKALG |

TABLE 3-continued

EXEMPLARY FC AMINO ACID SEQUENCES

| Name | SEQ ID NO | Fc Sequence |
|---|---|---|
| | | APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPGK |
| hIgG1 (with C-terminal lysine)-LS | 2509 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVLHEALHSHYTQKSLSLSPGK |
| hIgG1 (with C-terminal lysine)-N297A/LS | 2510 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYASTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVLHEALHSHYTQKSLSLSPGK |
| hIgG1 (with C-terminal lysine)-D265A/LS | 2511 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVAVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVLHEALHSHYTQKSLSLSPGK |
| hIgG1 (with C-terminal lysine)-LALA/LS | 2512 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHSHYTQKSLSLSPGK |
| hIgG1 (with C-terminal lysine)-LAGA/LS | 2513 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHSHYTQKSLSLSPGK |
| hIgG1 (with C-terminal lysine)-LALAGA/LS | 2514 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHSHYTQKSLSLSPGK |
| hIgG1 (with C-terminal lysine)-LALAPG/LS | 2515 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVLHQDWLNGKEYKCKVSNKALG APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHSHYTQKSLSLSPGK |
| hIgG1 (with C-terminal lysine)-DHS | 2516 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYNSTYRVVSVLTVDHHDWLNGKEYKCKVSNKALPA |

TABLE 3-continued

EXEMPLARY FC AMINO ACID SEQUENCES

| Name | SEQ ID NO | Fc Sequence |
|---|---|---|
| | | PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHSHYTQKSLSLSPGK |
| hIgG1 (with C-terminal lysine)-N297A/DHS | 2517 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYASTYRVVSVLTVDHHDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHSHYTQKSLSLSPGK |
| hIgG1 (with C-terminal lysine)-D265A/DHS | 2518 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVAVSHEDPEVKFNWYVDGVEVHNAKT KPREEQYNSTYRVVSVLTVDHHDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHSHYTQKSLSLSPGK |
| hIgG1 (with C-terminal lysine)-LALA/DHS | 2519 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVDHHDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHSHYTQKSLSLSPGK |
| hIgG1 (with C-terminal lysine)-LAGA/DHS | 2520 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLMISRTPEVTCVVVDVSHEDPEVKFNWYVDGVEVHNAK TKPREEQYNSTYRVVSVLTVDHHDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHSHYTQKSLSLSPGK |
| hIgG1 (with C-terminal lysine)-LALAGA/DHS | 2521 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLMISRTPEVTCVVVDVSHEDPEVKFNWYVDGVEVHNAK TKPREEQYNSTYRVVSVLTVDHHDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHSHYTQKSLSLSPGK |
| hIgG1 (with C-terminal lysine)-LALAPG/DHS | 2522 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVDHHDWLNGKEYKCKVSNKALG APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHSHYTQKSLSLSPGK |
| hIgG1 (with C-terminal lysine)-LA | 2523 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVLHEALHAHYTQKSLSLSPGK |
| hIgG1 (with C-terminal lysine)-N297A/LA | 2524 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYASTYRVVSVLTVLHQDWLNGKEYKCKVSNKALPA |

TABLE 3-continued

| EXEMPLARY FC AMINO ACID SEQUENCES | | |
|---|---|---|
| Name | SEQ ID NO | Fc Sequence |
| | | PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVLHEALHAHYTQKSLSLSPGK |
| hIgG1 (with C-terminal lysine)-D265A/LA | 2525 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVAVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVLHEALHAHYTQKSLSLSPGK |
| hIgG1 (with C-terminal lysine)-LALA/LA | 2526 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHAHYTQKSLSLSPGK |
| hIgG1 (with C-terminal lysine)-LAGA/LA | 2527 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHAHYTQKSLSLSPGK |
| hIgG1 (with C-terminal lysine)-LALAGA/LA | 2528 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHAHYTQKSLSLSPGK |
| hIgG1 (with C-terminal lysine)-LALAPG/LA | 2529 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVLHQDWLNGKEYKCKVSNKALG APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHAHYTQKSLSLSPGK |
| hIgG1 (with C-terminal lysine)-N434A | 2530 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHAHYTQKSLSLSPGK |
| hIgG1 (with C-terminal lysine)-N297A/N434A | 2531 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYASTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHAHYTQKSLSLSPGK |
| hIgG1 (with C-terminal lysine)-D265A/N434A | 2532 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVAVSHEDPEVKFNWYVDGVEVHNAKT KPREEQYNSTYRVVSVLTVLHQDWLNGKEYKCKVSNKALPA |

TABLE 3-continued

| EXEMPLARY FC AMINO ACID SEQUENCES | | |
|---|---|---|
| Name | SEQ ID NO | Fc Sequence |
| | | PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHAHYTQKSLSLSPGK |
| hIgG1 (with C-terminal lysine)-LALA/ N434A | 2533 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHAHYTQKSLSLSPGK |
| hIgG1 (with C-terminal lysine)-LAGA/ N434A | 2534 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHAHYTQKSLSLSPGK |
| hIgG1 (with C-terminal lysine)-LALAGA/ N434A | 2535 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHAHYTQKSLSLSPGK |
| hIgG1 (with C-terminal lysine)-LALAPG/ N434A | 2536 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVLHQDWLNGKEYKCKVSNKALG APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHAHYTQKSLSLSPGK |
| hIgG1 (with C-terminal lysine)-N434W | 2537 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHWHYTQKSLSLSPGK |
| hIgG1 (with C-terminal lysine)-N297A/ N434W | 2538 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYASTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHWHYTQKSLSLSPGK |
| hIgG1 (with C-terminal lysine)-D265A/ N434W | 2539 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVAVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHWHYTQKSLSLSPGK |

TABLE 3-continued

EXEMPLARY FC AMINO ACID SEQUENCES

| Name | SEQ ID NO | Fc Sequence |
|---|---|---|
| hIgG1 (with C-terminal lysine)-LALA/N434W | 2540 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHWHYTQKSLSLSPGK |
| hIgG1 (with C-terminal lysine)-LAGA/N434W | 2541 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHWHYTQKSLSLSPGK |
| hIgG1 (with C-terminal lysine)-LALAGA/N434W | 2542 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHWHYTQKSLSLSPGK |
| hIgG1 (with C-terminal lysine)-LALAPG/N434W | 2543 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVLHQDWLNGKEYKCKVSNKALG APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHWHYTQKSLSLSPGK |
| hIgG1 (with C-terminal lysine)/DQ | 2544 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRDPEVTCVVVDVSHEDPEVKFNWYVDGVEVHNAKT KPREEQYNSTYRVVSVLQVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPGK |
| hIgG1 (with C-terminal lysine)-N297A/DQ | 2545 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRDPEVTCVVVDVSHEDPEVKFNWYVDGVEVHNAKT KPREEQYASTYRVVSVLQVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPGK |
| hIgG1 (with C-terminal lysine)-D265A/DQ | 2546 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRDPEVTCVVVAVSHEDPEVKFNWYVDGVEVHNAKT KPREEQYNSTYRVVSVLQVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPGK |
| hIgG1 (with C-terminal lysine)-LALA/DQ | 2547 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRDPEVTCVVVDVSHEDPEVKFNWYVDGVEVHNAK TKPREEQYNSTYRVVSVLQVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPGK |

TABLE 3-continued

EXEMPLARY FC AMINO ACID SEQUENCES

| Name | SEQ ID NO | Fc Sequence |
|---|---|---|
| hIgG1 (with C-terminal lysine)-LAGA/DQ | 2548 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLMISRDPEVTCVVVDVSHEDPEVKFNWYVDGVEVHNAK TKPREEQYNSTYRVVSVLQVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPGK |
| hIgG1 (with C-terminal lysine)-LALAGA/DQ | 2549 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLMISRDPEVTCVVVDVSHEDPEVKFNWYVDGVEVHNAK TKPREEQYNSTYRVVSVLQVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPGK |
| hIgG1 (with C-terminal lysine)-LALAPG/DQ | 2550 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRDPEVTCVVVDVSHEDPEVKFNWYVDGVEVHNAK TKPREEQYNSTYRVVSVLQVLHQDWLNGKEYKCKVSNKALG APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPGK |
| hIgG1 (with C-terminal lysine)/DW | 2551 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRDPEVTCVVVDVSHEDPEVKFNWYVDGVEVHNAKT KPREEQYNSTYRVVSVLWVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPGK |
| hIgG1 (with C-terminal lysine)-N297A/DW | 2552 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRDPEVTCVVVDVSHEDPEVKFNWYVDGVEVHNAKT KPREEQYASTYRVVSVLWVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPGK |
| hIgG1 (with C-terminal lysine)-D265A/DW | 2553 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRDPEVTCVVVAVSHEDPEVKFNWYVDGVEVHNAKT KPREEQYNSTYRVVSVLWVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPGK |
| hIgG1 (with C-terminal lysine)-LALA/DW | 2554 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRDPEVTCVVVDVSHEDPEVKFNWYVDGVEVHNAK TKPREEQYNSTYRVVSVLWVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPGK |
| hIgG1 (with C-terminal lysine)-LAGA/DW | 2555 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLMISRDPEVTCVVVDVSHEDPEVKFNWYVDGVEVHNAK TKPREEQYNSTYRVVSVLWVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPGK |

TABLE 3-continued

EXEMPLARY FC AMINO ACID SEQUENCES

| Name | SEQ ID NO | Fc Sequence |
|---|---|---|
| hIgG1 (with C-terminal lysine)-LALAGA/DW | 2556 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLMISRDPEVTCVVVDVSHEDPEVKFNWYVDGVEVHNAK TKPREEQYNSTYRVVSVLWVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPGK |
| hIgG1 (with C-terminal lysine)-LALAPG/DW | 2557 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRDPEVTCVVVDVSHEDPEVKFNWYVDGVEVHNAK TKPREEQYNSTYRVVSVLWVLHQDWLNGKEYKCKVSNKALG APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPGK |
| hIgG1 (with C-terminal lysine)/YD | 2558 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLYISRDPEVTCVVVDVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPGK |
| hIgG1 (with C-terminal lysine)-N297A/YD | 2559 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLYISRDPEVTCVVVDVSHEDPEVKFNWYVDGVEVHNAKT KPREEQYASTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPGK |
| hIgG1 (with C-terminal lysine)-D265A/YD | 2560 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLYISRDPEVTCVVVAVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVMHEALHNHYTQKSLSLSPGK |
| hIgG1 (with C-terminal lysine)-LALA/YD | 2561 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLYISRDPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPGK |
| hIgG1 (with C-terminal lysine)-LAGA/YD | 2562 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLYISRDPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPGK |
| hIgG1 (with C-terminal lysine)-LALAGA/YD | 2563 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLYISRDPEVTCVVVDVSHEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPGK |

TABLE 3-continued

EXEMPLARY FC AMINO ACID SEQUENCES

| Name | SEQ ID NO | Fc Sequence |
|---|---|---|
| hIgG1 (with C-terminal lysine)-LALAPG/YD | 2564 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLYISRDPEVTCVVVDVSHEDPEVKFNWYVDGVEVHNAK TKPREEQYNSTYRVVSVLTVLHQDWLNGKEYKCKVSNKALG APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPGK |
| hIgG1 (with C-terminal lysine)/QVV | 2565 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYNSTYRVVSVLQVLHVDWLNGKEYKCKVSNKALPA PIEKTISKAKGQPREPQVYTLPPSRDELTKNQVSLTCLVKGFYP SDIVVEWESNGQPENNYKTTPPVLDSDGSFFLYSKLTVDKSRW QQGNVFSCSVMHEALHNHYTQKSLSLSPGK |
| hIgG1 (with C-terminal lysine)-N297A/QVV | 2566 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYASTYRVVSVLQVLHVDWLNGKEYKCKVSNKALPA PIEKTISKAKGQPREPQVYTLPPSRDELTKNQVSLTCLVKGFYP SDIVVEWESNGQPENNYKTTPPVLDSDGSFFLYSKLTVDKSRW QQGNVFSCSVMHEALHNHYTQKSLSLSPGK |
| hIgG1 (with C-terminal lysine)-D265A/QVV | 2567 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVAVSHEDPEVKFNWYVDGVEVHNAKT KPREEQYNSTYRVVSVLQVLHVDWLNGKEYKCKVSNKALPA PIEKTISKAKGQPREPQVYTLPPSRDELTKNQVSLTCLVKGFYP SDIVVEWESNGQPENNYKTTPPVLDSDGSFFLYSKLTVDKSRW QQGNVFSCSVMHEALHNHYTQKSLSLSPGK |
| hIgG1 (with C-terminal lysine)-LALA/QVV | 2568 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLQVLHVDWLNGKEYKCKVSNKALP APIEKTISKAKGQPREPQVYTLPPSRDELTKNQVSLTCLVKGFY PSDIVVEWESNGQPENNYKTTPPVLDSDGSFFLYSKLTVDKSR WQQGNVFSCSVMHEALHNHYTQKSLSLSPGK |
| hIgG1 (with C-terminal lysine)-LAGA/QVV | 2569 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLMISRTPEVTCVVVDVSHEDPEVKFNWYVDGVEVHNAK TKPREEQYNSTYRVVSVLQVLHVDWLNGKEYKCKVSNKALP APIEKTISKAKGQPREPQVYTLPPSRDELTKNQVSLTCLVKGFY PSDIVVEWESNGQPENNYKTTPPVLDSDGSFFLYSKLTVDKSR WQQGNVFSCSVMHEALHNHYTQKSLSLSPGK |
| hIgG1 (with C-terminal lysine)-LALAGA/QVV | 2570 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLMISRTPEVTCVVVDVSHEDPEVKFNWYVDGVEVHNAK TKPREEQYNSTYRVVSVLQVLHVDWLNGKEYKCKVSNKALP APIEKTISKAKGQPREPQVYTLPPSRDELTKNQVSLTCLVKGFY PSDIVVEWESNGQPENNYKTTPPVLDSDGSFFLYSKLTVDKSR WQQGNVFSCSVMHEALHNHYTQKSLSLSPGK |
| hIgG1 (with C-terminal lysine)-LALAPG/QVV | 2571 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLQVLHVDWLNGKEYKCKVSNKALG APIEKTISKAKGQPREPQVYTLPPSRDELTKNQVSLTCLVKGFY PSDIVVEWESNGQPENNYKTTPPVLDSDGSFFLYSKLTVDKSR WQQGNVFSCSVMHEALHNHYTQKSLSLSPGK |

TABLE 3-continued

EXEMPLARY FC AMINO ACID SEQUENCES

| Name | SEQ ID NO | Fc Sequence |
|---|---|---|
| hIgG1 (with C-terminal lysine)/ DDRVV | 2572 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRDPEVTCVVVDVSHEDPEVKFNWYVDGVEVDNAKT KPREEQYNSTYRVVSVLRVLHVDWLNGKEYKCKVSNKALPA PIEKTISKAKGQPREPQVYTLPPSRDELTKNQVSLTCLVKGFYP SDIVVEWESNGQPENNYKTTPPVLDSDGSFFLYSKLTVDKSRW QQGNVFSCSVMHEALHNHYTQKSLSLSPGK |
| hIgG1 (with C-terminal lysine)- N297A/DDRVV | 2573 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRDPEVTCVVVDVSHEDPEVKFNWYVDGVEVDNAKT KPREEQYASTYRVVSVLRVLHVDWLNGKEYKCKVSNKALPA PIEKTISKAKGQPREPQVYTLPPSRDELTKNQVSLTCLVKGFYP SDIVVEWESNGQPENNYKTTPPVLDSDGSFFLYSKLTVDKSRW QQGNVFSCSVMHEALHNHYTQKSLSLSPGK |
| hIgG1 (with C-terminal lysine)- D265A/DDRVV | 2574 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRDPEVTCVVVAVSHEDPEVKFNWYVDGVEVDNAKT KPREEQYNSTYRVVSVLRVLHVDWLNGKEYKCKVSNKALPA PIEKTISKAKGQPREPQVYTLPPSRDELTKNQVSLTCLVKGFYP SDIVVEWESNGQPENNYKTTPPVLDSDGSFFLYSKLTVDKSRW QQGNVFSCSVMHEALHNHYTQKSLSLSPGK |
| hIgG1 (with C-terminal lysine)- LALA/DDRVV | 2575 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRDPEVTCVVVDVSHEDPEVKFNWYVDGVEVDNAK TKPREEQYNSTYRVVSVLRVLHVDWLNGKEYKCKVSNKALP APIEKTISKAKGQPREPQVYTLPPSRDELTKNQVSLTCLVKGFY PSDIVVEWESNGQPENNYKTTPPVLDSDGSFFLYSKLTVDKSR WQQGNVFSCSVMHEALHNHYTQKSLSLSPGK |
| hIgG1 (with C-terminal lysine)- LAGA/DDRVV | 2576 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLMISRDPEVTCVVVDVSHEDPEVKFNWYVDGVEVDNAK TKPREEQYNSTYRVVSVLRVLHVDWLNGKEYKCKVSNKALP APIEKTISKAKGQPREPQVYTLPPSRDELTKNQVSLTCLVKGFY PSDIVVEWESNGQPENNYKTTPPVLDSDGSFFLYSKLTVDKSR WQQGNVFSCSVMHEALHNHYTQKSLSLSPGK |
| hIgG1 (with C-terminal lysine)- LALAGA/ DDRVV | 2577 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLMISRDPEVTCVVVDVSHEDPEVKFNWYVDGVEVDNAK TKPREEQYNSTYRVVSVLRVLHVDWLNGKEYKCKVSNKALP APIEKTISKAKGQPREPQVYTLPPSRDELTKNQVSLTCLVKGFY PSDIVVEWESNGQPENNYKTTPPVLDSDGSFFLYSKLTVDKSR WQQGNVFSCSVMHEALHNHYTQKSLSLSPGK |
| hIgG1 (with C-terminal lysine)- LALAPG/ DDRVV | 2578 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRDPEVTCVVVDVSHEDPEVKFNWYVDGVEVDNAK TKPREEQYNSTYRVVSVLRVLHVDWLNGKEYKCKVSNKALG APIEKTISKAKGQPREPQVYTLPPSRDELTKNQVSLTCLVKGFY PSDIVVEWESNGQPENNYKTTPPVLDSDGSFFLYSKLTVDKSR WQQGNVFSCSVMHEALHNHYTQKSLSLSPGK |
| hIgG1 (with C-terminal lysine)- Q311R/M428L | 2579 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYNSTYRVVSVLTVLHRDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVLHEALHNHYTQKSLSLSPGK |

TABLE 3-continued

EXEMPLARY FC AMINO ACID SEQUENCES

| Name | SEQ ID NO | Fc Sequence |
|---|---|---|
| hIgG1 (with C-terminal lysine)-N297A/Q311R/M428L | 2580 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVDVSHEDPEVKFNWYVDGVEVHNAKT KPREEQYASTYRVVSVLTVLHRDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVLHEALHNHYTQKSLSLSPGK |
| hIgG1 (with C-terminal lysine)-D265A/Q311R/M428L | 2581 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELLGGPSVFLFPPKPK DTLMISRTPEVTCVVVAVSHEDPEVKFNWYVDGVEVHNAKT KPREEQYNSTYRVVSVLTVLHRDWLNGKEYKCKVSNKALPA PIEKTISKAKGQPREPQVYTLPPSRDELTKNQVSLTCLVKGFYP SDIAVEWESNGQPENNYKTTPPVLDSDGSFFLYSKLTVDKSRW QQGNVFSCSVLHEALHNHYTQKSLSLSPGK |
| hIgG1 (with C-terminal lysine)-LALA/Q311R/M428L | 2582 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVLHRDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHNHYTQKSLSLSPGK |
| hIgG1 (with C-terminal lysine)-LAGA/Q311R/M428L | 2583 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPELAGAPSVFLFPPKP KDTLMISRTPEVTCVVVDVSHEDPEVKFNWYVDGVEVHNAK TKPREEQYNSTYRVVSVLTVLHRDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHNHYTQKSLSLSPGK |
| hIgG1 (with C-terminal lysine)-LALAGA/Q311R/M428L | 2584 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGAPSVFLFPPKP KDTLMISRTPEVTCVVVDVSHEDPEVKFNWYVDGVEVHNAK TKPREEQYNSTYRVVSVLTVLHRDWLNGKEYKCKVSNKALP APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHNHYTQKSLSLSPGK |
| hIgG1 (with C-terminal lysine)-LALAPG/Q311R/M428L | 2585 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVKFNWYVDGVEVHNAK TKPREEQYNSTYRVVSVLTVLHRDWLNGKEYKCKVSNKALG APIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVLHEALHNHYTQKSLSLSPGK |

In some embodiments, the Fc comprises an amino acid sequence having at least 80% sequence identity with any one of the amino acid sequences listed in TABLE 3. In some embodiments, the Fc comprises an amino acid sequence having at least 85% sequence identity with any one of the amino acid sequences listed in TABLE 3. In some embodiments, the Fc comprises an amino acid sequence having at least 90% sequence identity with any one of the amino acid sequences listed in TABLE 3. In some embodiments, the Fc comprises an amino acid sequence having at least 95% sequence identity with any one of the amino acid sequences listed in TABLE 3. In some embodiments, the Fc comprises an amino acid sequence having at least 96% sequence identity with any one of the amino acid sequences listed in TABLE 3. In some embodiments, the Fc comprises an amino acid sequence having at least 97% sequence identity with any one of the amino acid sequences listed in TABLE 3. In some embodiments, the Fc comprises an amino acid sequence having at least 98% sequence identity with any one of the amino acid sequences listed in TABLE 3. In some embodiments, the Fc comprises an amino acid sequence having at least 99% sequence identity with any one of the amino acid sequences listed in TABLE 3. In some embodiments, the Fc comprises the amino acid sequence according to any one of the amino acid sequences listed in TABLE 3.

In some embodiments, the TL1A binding protein comprises a Fc comprising one or more modifications in SEQ ID NO: 201. In some embodiments, the TL1A binding protein comprises a Fc comprising one or more modifications in SEQ ID NO: 202. In some embodiments, the TL1A binding protein comprises a Fc comprising one or more modifications in SEQ ID NO: 203. In some embodiments, the Fc comprises an amino acid sequence having at least 80% sequence identity with the amino acid sequence according to any one of SEQ ID NOS: 201-203. In some embodiments, the Fc comprises an amino acid sequence having at least 85% sequence identity with the amino acid sequence according to any one of SEQ ID NOs: 201-203. In some embodiments, the Fc comprises an amino acid sequence having at least 90% sequence identity with the amino acid sequence according to any one of SEQ ID NOs: 201-203. In some embodiments, the Fc comprises an amino acid sequence having at least 95% sequence identity with the amino acid sequence according to any one of SEQ ID NOs: 201-203. In some embodiments, the Fc comprises an amino acid sequence having at least 96% sequence identity with the amino acid sequence according to any one of SEQ ID NOs: 201-203. In some embodiments, the Fc comprises an amino acid sequence having at least 97% sequence identity with the amino acid sequence according to any one of SEQ ID NOs: 201-203. In some embodiments, the Fc comprises an amino acid sequence having at least 98% sequence identity with the amino acid sequence according to any one of SEQ ID NOs: 201-203. In some embodiments, the Fc comprises an amino acid sequence having at least 99% sequence identity with the amino acid sequence according to any one of SEQ ID NOs: 201-203. In some embodiments, the Fc comprises the amino acid sequence according to any one of SEQ ID NOs: 201-203.

In some embodiments, one or more modifications in the modified Fc is selected from the group consisting of: S298A, E333A, K334A, K326A, F243L, R292P, Y300L, V305I, P396L, F243L, R292P, Y300L, L235V, P396L, F243L, S239D, 1332E, A330L, S267E, L328F, D265S, S239E, K326A, A327H, G237F, K326E, G236A, D270L, H268D, S324T, L234F, N325L, V266L, and S267D. In some embodiments, one or more modifications in the modified Fc is selected from the group consisting of S228P, M252Y, S254T, T256E, T256D, T250Q, H285D, T307A, T307Q, T307R, T307W, L309D, Q411H, Q311V, A378V, E380A, M428L, N434A, N434S, N297A, D265A, L234A, L235A, and N434W.

In some embodiments, the modified Fc comprises a specific combination of amino acid substitutions selected from the group consisting of: L234A/L235A; V234A/G237A; L235A/G237A/E318A; S228P/L236E; H268Q/V309L/A330S/A331S; C220S/C226S/C229S/P238S; C226S/C229S/E3233P/L235V/L235A; L234F/L235E/P331S; C226S/P230S; L234A/G237A; L234A/L235A/G237A; Q311R/M428L; and L234A/L235A/P329G.

In some embodiments, the modified Fc comprises a specific combination of amino acid substitutions selected from the group consisting of M428L/N434S (LS); M252Y/S254T/T256E (YTE); T250Q/M428L; T307A/E380A/N434A; T256D/T307Q (DQ); T256D/T307W (DW); M252Y/T256D (YD); T307Q/Q311V/A378V (QVV); T256D/H285D/T307R/Q311V/A378V (DDRVV); L309D/Q311H/N434S (DHS); S228P/L235E (SPLE); L234A/L235A (LALA); M428L/N434A (LA); L234A/G237A (LAGA); L234A/L235A/G237A (LALAGA); L234A/L235A/P329G (LALAPG); N297A/YTE; D265A/YTE; LALA/YTE; LAGA/YTE; LALAGA/YTE; LALAPG/YTE; N297A/LS; D265A/LS; LALA/LS; LAGA/LS; LALAGA/LS; LALAPG/LS; N297A/DHS; D265A/DHS; LALA/DHS; LAGA/DHS; LALAGA/DHS; LALAPG/DHS: SP/YTE; SPLE/YTE; SP/LS; SPLE/LS; SP/DHS; SPLE/DHS; N297A/LA; D265A/LA; LALA/LA; LAGA/LA; LALAGA/LA; LALAPG/LA; N297A/N434A; D265A/N434A; LALA/N434A; LAGA/N434A; LALAGA/N434A; LALAPG/N434A; N297A/N434W; D265A/N434W; LALA/N434W; LAGA/N434W; LALAGA/N434W; LALAPG/N434W; N297A/DQ; D265A/DQ; LALA/DQ; LAGA/DQ; LALAGA/DQ; LALAPG/DQ; N297A/DW; D265A/DW; LALA/DW; LAGA/DW; LALAGA/DW; LALAPG/DW; N297A/YD; D265A/YD; LALA/YD; LAGA/YD; LALAGA/YD; LALAPG/YD; N297A/QVV; D265A/QVV; LALA/QVV; LAGA/QVV, LALAGA/QVV; LALAPG/QVV; N297A/DDRVV; D265A/DDRVV; LALA/DDRVV; LAGA/DDRVV; LALAGA/DDRVV; LALAPG/DDRVV; SP/Q311R/M428L; SPLE/Q311R/M428L; N297A/Q311R/M428L; D265A/Q311R/M428L; LALA/Q311R/M428L; LAGA/Q311R/M428L; LALAGA/Q311R/M428L; and LALAPG/Q311R/M428L. In some embodiments, the modified Fc comprises a specific combination of amino acid substitutions selected from the group consisting of M428L/N434S (LS) and M252Y/S254T/T256E (YTE). In some embodiments, the modified Fc comprises M428L/N434S (LS) (e.g., SEQ ID NO: 219, SEQ ID NO: 236, SEQ ID NO: 243) modifications. In some embodiments, the modified Fc comprises M252Y/S254T/T256E (YTE) (e.g., SEQ ID NO: 212, SEQ ID NO: 233, SEQ ID NO: 242) modifications.

In some embodiments, the TL1A binding proteins described herein include modifications to improve its ability to mediate effector function. Such modifications are known in the art and include afucosylation, or engineering of the affinity of the Fc towards an activating receptor, mainly FCGR3a for antibody-dependent cellular cytotoxicity (ADCC), and towards C1q for complement-dependent cytotoxicity (CDC).

In some aspects, an antibody provided herein comprises a Fc domain (e.g., IgG1) with reduced fucose content at position Asn 297 (EU numbering) compared to a naturally occurring Fc domain. Such Fc domains are known to have improved ADCC. In some aspects, such antibodies do not comprise any fucose at position Asn 297.

In some embodiments, the TL1A binding proteins described herein comprise an Fc region with one or more amino acid substitutions which improve ADCC, such as a substitution at one or more of positions 298, 333, and 334 of the Fc region. In some embodiments, an antibody provided herein comprises an Fc region with one or more amino acid substitutions at positions 239, 332, and 330.

In some embodiments, the Fc comprises an amino acid sequence having at least 80% sequence identity with the amino acid sequence according to any one of SEQ ID NOs: 204-312. In some embodiments, the Fc comprises an amino acid sequence having at least 85% sequence identity with the amino acid sequence according to any one of SEQ ID NOs: 204-312. In some embodiments, the Fc comprises an amino acid sequence having at least 90% sequence identity with the amino acid sequence according to any one of SEQ ID NOs: 204-312. In some embodiments, the Fc comprises an amino acid sequence having at least 95% sequence identity with the amino acid sequence according to any one of SEQ ID NOs: 204-312. In some embodiments, the Fc comprises an amino acid sequence having at least 96% sequence identity with the amino acid sequence according to any one of SEQ ID NOs: 204-312. In some embodiments, the Fc comprises an amino acid sequence having at least 97% sequence identity with the amino acid sequence according to any one of SEQ ID NOs: 204-312. In some embodiments, the Fc comprises an amino acid sequence having at least 98% sequence identity with the amino acid sequence according to any one of SEQ ID NOs:

204-312. In some embodiments, the Fc comprises an amino acid sequence having at least 99% sequence identity with the amino acid sequence according to any one of SEQ ID NOs: 204-312. In some embodiments, the Fc comprises the amino acid sequence according to any one of SEQ ID NOS: 204-312.

In some embodiments, the Fc comprises a C-terminal lysine (e.g., SEQ ID NOs: 2495-2585) for use as disclosed herein. In some embodiments, the Fc comprises an amino acid sequence having at least 80% sequence identity with the amino acid sequence according to any one of SEQ ID NOs: 2495-2585. In some embodiments, the Fc comprises an amino acid sequence having at least 85% sequence identity with the amino acid sequence according to any one of SEQ ID NOs: 2495-2585. In some embodiments, the Fc comprises an amino acid sequence having at least 90% sequence identity with the amino acid sequence according to any one of SEQ ID NOs: 2495-2585. In some embodiments, the Fc comprises an amino acid sequence having at least 95% sequence identity with the amino acid sequence according to any one of SEQ ID NOs: 2495-2585. In some embodiments, the Fc comprises an amino acid sequence having at least 96% sequence identity with the amino acid sequence according to any one of SEQ ID NOs: 2495-2585. In some embodiments, the Fc comprises an amino acid sequence having at least 97% sequence identity with the amino acid sequence according to any one of SEQ ID NOs: 2495-2585. In some embodiments, the Fc comprises an amino acid sequence having at least 98% sequence identity with the amino acid sequence according to any one of SEQ ID NOs: 2495-2585. In some embodiments, the Fc comprises an amino acid sequence having at least 99% sequence identity with the amino acid sequence according to any one of SEQ ID NOs: 2495-2585. In some embodiments, the Fc comprises the amino acid sequence according to any one of SEQ ID NOs: 2495-2585.

In some embodiments, the TL1A binding proteins described herein comprise an Fc region with at least one galactose residue in the oligosaccharide attached to the Fc region. Such antibody variants may have improved CDC function.

In some embodiments, the TL1A binding proteins described herein comprise one or more alterations that improve or diminish C1q binding and/or CDC.

In some embodiments, the Fc region comprises one or more amino acid substitutions, wherein the one or more substitutions result in an increase in one or more of antibody half-life, ADCC activity, ADCP activity, or CDC activity compared with the Fc without the one or more substitutions. In some embodiments, the one or more amino acid substitutions results in increased antibody half-life at pH 6.0 compared to an antibody comprising a wild-type Fc region. In some embodiments, the antibody has an increased half-life that is about 10,000-fold, 1,000-fold, 500-fold, 100-fold, 50-fold, 20-fold, 10-fold, 9-fold, 8-fold, 7-fold, 6-fold, 5-fold, 4.5-fold, 4-fold, 3.5-fold, 3-fold, 2.5-fold, 2-fold, 1.95-fold, 1.9-fold, 1.85-fold, 1.8-fold, 1.75-fold, 1.7-fold, 1.65-fold, 1.6-fold, 1.55-fold, 1.50-fold, 1.45-fold, 1.4-fold, 1.35-fold, 1.3-fold, 1.25-fold, 1.2-fold, 1.15-fold, 1.1-fold, or 1.05-fold longer compared to an antibody comprising a wild-type Fc region.

In some embodiments, the Fc region comprises one or more amino acid substitutions, wherein the one or more substitutions result in a decrease in one or more of ADCC activity, ADCP activity, or CDC activity compared with the Fc without the one or more substitutions, In some embodiments, the Fc region binds an Fcγ Receptor selected from the group consisting of: FcγRI, FcγRIIa, FcγRIIb, FcγRIIc, FcγRIIIa, and FcγRIIIb. In some embodiments, the Fc region binds an Fcγ Receptor with higher affinity at pH 6.0 compared to an antibody comprising a wild-type Fc region.

In some embodiments, the TL1A binding proteins described herein comprise an extended half-life (i.e., serum half-life). In some embodiments, the TL1A binding proteins described herein comprise a half-life of at least about 10, 12, 14, 16, 18, 20, 22, 24, 26, 28, 42, 56, 70, 84, 96, or more than 96 days. In some embodiments, the TL1A binding proteins described herein comprise a half-life in a range of about 10 to about 20 days, about 10 to about 30 days, about 18 days to about 30 days, about 14 days to about 96 days, about 14 days to about 84 days, about 14 days to about 70 days, about 14 days to about 56 days, about 14 days to about 42 days, about 14 days to about 28 days, of about 28 days to about 96 days, about 28 days to about 84 days, about 28 days to about 70 days, about 28 days to about 56 days, about 28 days to about 42 days, of about 42 days to about 96 days, about 42 days to about 84 days, about 42 days to about 70 days, or about 42 days to about 56 days. In some embodiments, the TL1A binding proteins described herein comprise a half-life in a range of about 42 days to about 56 days. In some embodiments, the TL1A binding proteins described herein comprise a half-life of at least about 18 days. In some embodiments, the TL1A binding proteins described herein comprise a half-life of about 18 days. In some embodiments, the TL1A binding proteins described herein comprise a half-life of at least about 50 days. In some embodiments, the TL1A binding proteins described herein comprise a half-life of about 50 days, Methods of measuring half-life are known in the art. In some embodiments, the half-life is measured in a rodent model, such as Tg276 mice. In some embodiments, the half-life is measured in a non-human primate. In some embodiments, the half-life is measured in a human. In some embodiments, the half-life is measured following intravenous administration. In some embodiments, the half-life is measured following subcutaneous administration.

In some embodiments, the TL1A binding proteins described herein have a half-life that is at least 20% longer than a comparator antibody. In some embodiments, the comparator antibody comprises the same complementarity determining regions and variable regions but different Fc regions. In some embodiments, the half-life of the TL1A binding proteins described herein is at least 30%, at least 40%, at least 50%, at least 60%, at least 70%, at least 80%, or at least 90% longer than the half-life of the comparator antibody. In some embodiments, the half-life of the TL1A binding proteins described herein is longer than the half-life of the comparator antibody by at least 2 fold, at least 3 fold, at least 4 fold, at least 5 fold, at least 6 fold, at least 7 fold, at least 8 fold, at least 9 fold, or at least 10 fold.

Methods of Treatment

Provided herein are methods of treatment comprising administering a TL1A binding protein. Described herein, in some embodiments, are methods of treating an inflammatory bowel disease in a patient in need thereof, the method comprising subcutaneously or intravenously administering to the patient an effective amount of an TL1A binding protein comprising a modified Fc region. Described herein, in some embodiments, are methods of treating an inflammatory bowel disease in a patient in need thereof, the method comprising subcutaneously or intravenously administering to the patient an effective amount of an TL1A binding protein comprising a) a heavy chain variable region (VH) comprising (i) a CDR1 having an amino acid sequence according to any one of CDRH1 sequences listed in TABLE 1.1 A, TABLE 1.1 B, and TABLE 1.1 C, (ii) a CDR2 having an amino acid sequence according to any one of CDRH2 sequences listed in TABLE 1.1 A, TABLE 1.1 B, and TABLE 1.1 C, and (iii) a CDR3 having an amino acid sequence according to any one of CDRH3 sequences listed in TABLE 1.1 A, TABLE 1.1 B, and TABLE 1.1 C; and b) a light chain variable region (VL) comprising (i) a CDR1 having an amino acid sequence according to any one of CDRL1 sequences listed in TABLE 1.1 A, TABLE 1.1 B, and TABLE 1.1 C, (ii) a CDR2 having an amino acid sequence according to any one of CDRL2 sequences listed in TABLE 1.1 A, TABLE 1.1 B, and TABLE 1.1 C, and (iii) a CDR3 having an amino acid sequence according to any one of CDRL3 sequences listed in TABLE 1.1 A, TABLE 1.1 B, and TABLE 1.1 C.

In some embodiments, are methods of treating an inflammatory bowel disease in a patient in need thereof, the method comprising subcutaneously or intravenously administering to the patient an effective amount of an TL1A binding protein comprising: a) a heavy chain variable region (VH) comprising (i) a CDR1 having an amino acid sequence according to any one of CDRH1 sequences listed in TABLE 1.1 A, TABLE 1.1 B, and TABLE 1.1 C, (ii) a CDR2 having an amino acid sequence according to any one of CDRH2 sequences listed in TABLE 1.1 A, TABLE 1.1 B, and TABLE 1.1 C, and (iii) a CDR3 having an amino acid sequence according to any one of CDRH3 sequences listed in TABLE 1.1 A, TABLE 1.1 B, and TABLE 1.1 C; b) a light chain variable region (VL) comprising (i) a CDR1 having an amino acid sequence according to any one of CDRL1 sequences listed in TABLE 1.1 A, TABLE 1.1 B, and TABLE 1.1 C, (ii) a CDR2 having an amino acid sequence according to any one of CDRL2 sequences listed in TABLE 1.1 A, TABLE 1.1 B, and TABLE 1.1 C, and (iii) a CDR3 having an amino acid sequence according to any one of CDRL3 sequences listed in TABLE 1.1 A, TABLE 1.1 B, and TABLE 1.1 C; and c) a modified Fc that extends half-life of the TL1A binding protein as compared to a TL1A binding protein that does not comprise the modified Fc.

In some embodiments, are methods of treating an inflammatory bowel disease in a patient in need thereof, the method comprising subcutaneously or intravenously administering to the patient an effective amount of an TL1A binding protein, wherein the TL1A binding protein specifically binds to an epitope of TL1A and comprises a Fc domain comprising amino acid modifications L234A/L235A (LALA) and/or M252Y, S254T, and T256E (YTE).

In some embodiments, the inflammatory bowel disease is Crohn's disease or ulcerative colitis. In some embodiments, the inflammatory bowel disease is ulcerative colitis. In some embodiments, the inflammatory bowel disease is Crohn's disease.

Described herein, iIn some embodiments, are methods of treating an inflammatory disease in a patient in need thereof, the method comprising subcutaneously or intravenously administering to the patient an effective amount of an TL1A binding protein comprising a) a heavy chain variable region (VH) comprising (i) a CDR1 having an amino acid sequence according to any one of CDRH1 sequences listed in TABLE 1.1 A, TABLE 1.1 B, and TABLE 1.1 C, (ii) a CDR2 having an amino acid sequence according to any one of CDRH2 sequences listed in TABLE 1.1 A, TABLE 1.1 B, and TABLE 1.1 C, and (iii) a CDR3 having an amino acid sequence according to any one of CDRH3 sequences listed in TABLE 1.1 A, TABLE 1.1 B, and TABLE 1.1 C; and b) a light chain variable region (VL) comprising (i) a CDR1 having an amino acid sequence according to any one of CDRL1 sequences listed in TABLE 1.1 A, TABLE 1.1 B, and TABLE 1.1 C, (ii) a CDR2 having an amino acid sequence according to any one of CDRL2 sequences listed in TABLE 1.1 A, TABLE 1.1 B, and TABLE 1.1 C, and (iii) a CDR3 having an amino acid sequence according to any one of CDRL3 sequences listed in TABLE 1.1 A, TABLE 1.1 B, and TABLE 1.1 C.

In some embodiments, are methods of treating an inflammatory disease in a patient in need thereof, the method comprising subcutaneously or intravenously administering to the patient an effective amount of an TL1A binding protein comprising: a) a heavy chain variable region (VH) comprising (i) a CDR1 having an amino acid sequence according to any one of CDRH1 sequences listed in TABLE 1.1 A, TABLE 1.1 B, and TABLE 1.1 C, (ii) a CDR2 having an amino acid sequence according to any one of CDRH2 sequences listed in TABLE 1.1 A, TABLE 1.1 B, and TABLE 1.1 C, and (iii) a CDR3 having an amino acid sequence according to any one of CDRH3 sequences listed in TABLE 1.1 A, TABLE 1.1 B, and TABLE 1.1 C; b) a light chain variable region (VL) comprising (i) a CDR1 having an amino acid sequence according to any one of CDRL1 sequences listed in TABLE 1.1 A, TABLE 1.1 B, and TABLE 1.1 C, (ii) a CDR2 having an amino acid sequence according to any one of CDRL2 sequences listed in TABLE 1.1 A, TABLE 1.1 B, and TABLE 1.1 C, and (iii) a CDR3 having an amino acid sequence according to any one of CDRL3 sequences listed in TABLE 1.1 A, TABLE 1.1 B, and TABLE 1.1 C; and c) a modified Fc that extends half-life of the TL1A binding protein as compared to a TL1A binding protein that does not comprise the modified Fc.

In some embodiments, are methods of treating an inflammatory disease in a patient in need thereof, the method comprising subcutaneously or intravenously administering to the patient an effective amount of an TL1A binding protein, wherein the TL1A binding protein specifically binds to an epitope of TL1A and comprises a Fc domain comprising amino acid modifications L234A/L235A (LALA) and/or M252Y, S254T, and T256E (YTE).

In some embodiments, are methods of treating an inflammatory disease in a patient in need thereof, the method comprising subcutaneously or intravenously administering to the patient an effective amount of a TL1A binding protein described herein. In some embodiments, the inflammatory disease is psoriasis. In some embodiments, the inflammatory disease is psoriatic arthritis. In some embodiments, the inflammatory disease is hidradenitis suppurativa. In some embodiments, administration of the TL1A binding protein is subcutaneous. In some embodiments, administration of the TL1A binding protein is intravenous.

Described herein, in certain embodiments, are methods of treating a gastrointestinal inflammatory disease in a patient in need thereof. As used herein, the term "gastrointestinal inflammatory disease" refers to a disease of the gastrointestinal tract that involves inflammatory pathways. For example, the gastrointestinal inflammatory disease includes, but is not limited to, inflammatory bowel disease, ulcerative colitis (with or without exposure to anti-tumor necrosis factor (anti-TNF). Crohn's disease (including fistulizing Crohn's Disease), chronic pouchitis, collagenous gastritis, microscopic or collagenous colitis, colitis (including immune mediated colitis), sclerosing cholangitis (including in subjects with underlying inflammatory bowel disease, celiac enteritis, ileitis. In other aspects of the disclosure, provided herein are methods of treating Intestinal Acute Graft Versus Host Disease (aGVHD) (e.g. in subjects undergoing allogeneic hematopoietic stem cell transplantation (Allo-HSCT)), steroid-refractory acute intestinal graft-versus-host disease (GvHD) (e.g. in subjects who have undergone Allo-HSCT), Type 1 diabetes (T1D) (e.g. with or without anti-TNF pre-treatment), immune checkpoint inhibitor-related colitis in subjects with genitourinary cancer or melanoma.

In some embodiments, the disease is a gastrointestinal inflammatory disease. In some embodiments, the disease is an inflammatory bowel disease. In some embodiments, the inflammatory bowel disease is Crohn's disease. In some embodiments, the inflammatory bowel disease is ulcerative colitis.

In some embodiments, are methods of treating an inflammatory bowel disease in a patient in need thereof, the method comprising subcutaneously or intravenously administering to the patient an effective amount of a TL1A binding protein described herein. In some embodiments, the inflammatory bowel disease is Crohn's disease or ulcerative colitis. In some embodiments, the inflammatory bowel disease is ulcerative colitis. In some embodiments, the inflammatory bowel disease is Crohn's disease. In some embodiments, administration of the TL1A binding protein is subcutaneous. In some embodiments, administration of the TL1A binding protein is intravenous.

In some embodiments, are methods of treating an inflammatory disease in a patient in need thereof, the method comprising subcutaneously or intravenously administering to the patient an effective amount of a TL1A antigen binding protein that specifically binds to a TL1A polypeptide comprising SEQ ID NO: 2493 or 2494, wherein the TL1A antigen binding protein is an antibody.

In some embodiments, are methods of treating an inflammatory bowel disease in a patient in need thereof, the method comprising subcutaneously or intravenously administering to the patient an effective amount of a TL1A antigen binding protein that specifically binds to a TL1A polypeptide comprising SEQ ID NO: 2493 or 2494, wherein the TL1A antigen binding protein is an antibody.

In some embodiments, are methods of treating an inflammatory disease in a patient in need thereof, the method comprising subcutaneously or intravenously administering to the patient an effective amount of a TL1A antigen binding protein described herein that specifically binds to a TL1A polypeptide comprising SEQ ID NO: 2493 at any one of amino acid residues of Table 12. In some embodiments, are methods of treating an inflammatory disease in an patient in need thereof, the method comprising subcutaneously or intravenously administering to the patient an effective amount of a TL1A antigen binding protein described herein that specifically binds to a TL1A polypeptide comprising SEQ ID NO: 2493 at any one of amino acid residues of Val 102, Arg 103, Gln 104, Glu 120, Glu 122, Leu 123, and Arg 156, and Tyr 238, wherein the TL1A antigen binding protein is an antibody. In some embodiments, the TL1A antigen binding protein specifically binds to the TL1A sequences at amino acid residues Val 102, Arg 103, Gln 104, Glu 120, Glu 122, Leu 123, and Arg 156, and Tyr 238. In some embodiments, are methods of treating an inflammatory disease in a patient in need thereof, the method comprising subcutaneously or intravenously administering to the patient an effective amount of a TL1A antigen binding protein described herein that specifically binds to a TL1A polypeptide comprising SEQ ID NO: 2493 at any one of amino acid residues of Table 13. In some embodiments, are methods of treating an inflammatory disease in a patient in need thereof, the method comprising subcutaneously or intravenously administering to the patient an effective amount of a TL1A antigen binding protein described herein that specifically binds to a TL1A polypeptide comprising SEQ ID NO: 2493 at any one of amino acid residues of Table 14. In some embodiments, are methods of treating an inflammatory disease in a patient in need thereof, the method comprising subcutaneously or intravenously administering to the patient an effective amount of a TL1A antigen binding protein described herein that specifically binds to a TL1A polypeptide comprising SEQ ID NO: 2493 at any one of amino acid residues of Lys243, Lys240, Thr239, Tyr238, Asp237, Val236, Leu235, Ser234, Ile233, Asp232, Met158, Arg156, Trp119, His118, Lys111, Phe110, His109, Gln108, Thr107, Pro106, Thr105, Gln104, Arg103, Val102, and Val101. In some embodiments, are methods of treating an inflammatory disease in a patient in need thereof, the method comprising subcutaneously or intravenously administering to the patient an effective amount of a TL1A antigen binding protein described herein that specifically binds to a TL1A polypeptide comprising SEQ ID NO: 2493 at any one of amino acid residues of Lys240, Thr239, Tyr238, Asp237, Val236, Leu235, Ser234, Gln104, and Arg103, Val102, and Val101. In some embodiments, the inflammatory disease is psoriasis. In some embodiments, the inflammatory disease is psoriatic arthritis. In some embodiments, the inflammatory disease is hidradenitis suppurativa. In some embodiments, administration of the TL1A binding protein is subcutaneous. In some embodiments, administration of the TL1A binding protein is intravenous.

In some embodiments, are methods of treating an inflammatory bowel disease in a patient in need thereof, the method comprising subcutaneously or intravenously administering to the patient an effective amount of a TL1A antigen binding protein described herein that specifically binds to a TL1A polypeptide comprising SEQ ID NO: 2493 at any one of amino acid residues of Table 12. In some embodiments, are methods of treating an inflammatory bowel disease in a patient in need thereof, the method comprising subcutaneously or intravenously administering to the patient an effective amount of a TL1A antigen binding protein described herein that specifically binds to a TL1A polypeptide comprising SEQ ID NO: 2493 at any one of amino acid residues of Val 102, Arg 103, Gln 104, Glu 120, Glu 122, Leu 123, and Arg 156, and Tyr 238, wherein the TL1A antigen binding protein is an antibody. In some embodiments, the TL1A antigen binding protein specifically binds to the TL1A sequences at amino acid residues Val 102, Arg 103, Gln 104, Glu 120, Glu 122, Leu 123, and Arg 156, and Tyr 238. In some embodiments, are methods of treating an inflammatory bowel disease in a patient in need thereof, the method comprising subcutaneously or intravenously administering to the patient an effective amount of a TL1A antigen binding protein described herein that specifically binds to a TL1A polypeptide comprising SEQ ID NO: 2493 at any one of amino acid residues of Table 13. In some embodiments, are methods of treating an inflammatory bowel disease in a patient in need thereof, the method comprising subcutaneously or intravenously administering to the patient an effective amount of a TL1A antigen binding protein described herein that specifically binds to a TL1A polypeptide comprising SEQ ID NO: 2493 at any one of amino acid residues of Table 14. In some embodiments, are methods of treating an inflammatory bowel disease in a patient in need thereof, the method comprising subcutaneously or intravenously administering to the patient an effective amount of a TL1A antigen binding protein described herein that specifically binds to a TL1A polypeptide comprising SEQ ID NO: 2493 at any one of amino acid residues of Lys243, Lys240, Thr239, Tyr238, Asp237, Val236, Leu235, Ser234, Ile233, Asp232, Met158, Arg156, Trp119, His118, Lys111, Phe110, His109, Gln108, Thr107, Pro106, Thr105, Gln104, Arg103, Val102, and Val101. In some embodiments, are methods of treating an inflammatory bowel disease in a patient in need thereof, the method comprising subcutaneously or intravenously administering to the patient an effective amount of a TL1A antigen binding protein described herein that specifically binds to a TL1A polypeptide comprising SEQ ID NO: 2493 at any one of amino acid residues of Lys240, Thr239, Tyr238. Asp237, Val236, Leu235, Ser234, Gln104, and Arg103, Val102, and Val101. In some embodiments, the inflammatory bowel disease is Crohn's disease or ulcerative colitis. In some embodiments, the inflammatory bowel disease is ulcerative colitis. In some embodiments, the inflammatory bowel disease is Crohn's disease. In some embodiments, administration of the TL1A binding protein is subcutaneous. In some embodiments, administration of the TL1A binding protein is intravenous.

In some embodiments, the inflammatory disease is psoriasis. In some embodiments, the inflammatory disease is psoriatic arthritis. In some embodiments, the inflammatory disease is hidradenitis suppurativa.

In some embodiments, administration of the TL1A binding protein is intravenous, intratumoral, intramuscular, subcutaneous, intralesional, intraintestinal, intracolonic, intrarectal, intrapouch, or intraperitoneal. In some embodiments, administration of the TL1A binding protein is through a parenteral route such as intravenous, intramuscular, subcutaneous, intraarterial, or intraperitoneal administration. In some embodiments, administration of the TL1A binding protein is intravenous or subcutaneous. In some embodiments, administration of the TL1A binding protein is intravenous. In some embodiments, administration of the TL1A binding protein is subcutaneous.

Administration of the TL1A binding protein can occur at various intervals. In some embodiments, the TL1A binding protein is administered to the patient at least once at an interval more than 8 weeks. In some embodiments, the interval is about 2 weeks, 3 weeks, 4 weeks, 5 weeks, 6 weeks, 7 weeks, 8 weeks, 9 weeks, 10 weeks, 11 weeks, 12 weeks, 13 weeks, 14 weeks, 15 weeks, 16 weeks, 17 weeks, 18 weeks, 19 weeks, 20 weeks, 21 weeks, 22 weeks, 23, weeks, 24, weeks, 25 weeks, 26 weeks or more than 26 weeks. In some embodiments, the interval is about 12 to about 22 weeks. In some embodiments, the interval is about 12 to about 20 weeks. In some embodiments, the interval is about 12 to about 18 weeks. In some embodiments, the interval is about 12 to about 16 weeks. In some embodiments, the interval is about 12 to about 14 weeks. In some embodiments, the interval is about 16 to about 26 weeks. In some embodiments, the interval is about 16 to about 24 weeks. In some embodiments, the interval is about 16 to about 22 weeks. In some embodiments, the interval is about 16 to about 20 weeks. In some embodiments, the interval is about 16 to about 18 weeks. In some embodiments, the interval is about 20 to about 26 weeks. In some embodiments, the interval is about 20 to about 24 weeks. In some embodiments, the interval is about 20 to about 22 weeks. In some embodiments, the interval is 8 about 12 weeks. In some embodiments, the interval is 8 about 10 weeks. In some embodiments, the interval is about 12 weeks. In some embodiments, the interval is about 8 weeks.

Pharmaceutical Compositions

Provided herein are compositions, and systems, comprising a TL1A binding protein. The present disclosure also features pharmaceutical compositions that contain a therapeutically effective amount of the TL1A binding proteins described herein. The composition can be formulated for use in a variety of drug delivery systems. One or more physiologically acceptable excipients or carriers can also be included in the composition for proper formulation. Suitable formulations for use in the present disclosure are found in Remington's Pharmaceutical Sciences. Mack Publishing Company. Philadelphia, Pa., 17th ed., 1985. For a brief review of methods for drug delivery, see, e.g., Langer (Science 249:1527-1533, 1990).

In some embodiments, a pharmaceutical composition may contain formulation materials for modifying, maintaining or preserving, for example, the pH, osmolarity, viscosity, clarity, color, isotonicity, odor, sterility, stability, rate of dissolution or release, adsorption or penetration of the composition. In such embodiments, suitable formulation materials include, but are not limited to, amino acids (such as glycine, glutamine, asparagine, arginine (e.g., arginine-HCl), histidine, or lysine); antimicrobials; antioxidants (such as ascorbic acid, sodium sulfite or sodium hydrogen-sulfite); buffers (such as borate, bicarbonate, Tris-HCl, citrates, phosphates or other organic acids); bulking agents (such as mannitol or glycine); chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides; and other carbohydrates (such as glucose, mannose or dextrins); proteins (such as serum albumin, gelatin or immunoglobulins); coloring, flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate 80, triton, tromethamine, lecithin, cholesterol, tyloxapal); stability enhancing agents (such as sucrose or sorbitol); tonicity enhancing agents (such as alkali metal halides, preferably sodium or potassium chloride, mannitol sorbitol); delivery vehicles; diluents; excipients and/or pharmaceutical adjuvants (see. Remington's Pharmaceutical Sciences, 18th ed. (Mack Publishing Company, 1990)).

In some embodiments, a pharmaceutical composition comprises one or more of: histidine; arginine or a salt thereof; ethylenediaminetetraacetic acid (EDTA); and polysorbate 80. In some embodiments, a pharmaceutical composition comprises one or more of: histidine; arginine or a salt thereof; ethylenediaminetetraacetic acid (EDTA); and poloxamer 188. In some embodiments, a pharmaceutical composition comprises one or more of: histidine; sucrose; and polysorbate 80.

In some embodiments, a pharmaceutical composition is citrate-free.

In some embodiments, a pharmaceutical composition may contain nanoparticles, e.g., polymeric nanoparticles, liposomes, or micelles.

In some embodiments, a pharmaceutical composition may contain a sustained- or controlled-delivery formulation. Techniques for formulating sustained- or controlled-delivery means, such as liposome carriers, bio-erodible microparticles or porous beads and depot injections, are also known to those skilled in the art. Sustained-release preparations may include, e.g., porous polymeric microparticles or semi-permeable polymer matrices in the form of shaped articles, e.g., films, or microcapsules. Sustained release matrices may include polyesters, hydrogels, polylactides, copolymers of L-glutamic acid and gamma ethyl-L-glutamate, poly (2-hydroxyethyl-inethacrylate), ethylene vinyl acetate, or poly-D (-)-3-hydroxy butyric acid. Sustained release compositions may also include liposomes that can be prepared by any of several methods known in the art.

Pharmaceutical compositions containing an TL1A binding protein disclosed herein can be presented in a dosage unit form and can be prepared by any suitable method. A pharmaceutical composition should be formulated to be compatible with its intended route of administration. Examples of routes of administration are intravenous (IV), intradermal, inhalation, transdermal, topical, transmucosal, intrathecal and rectal administration. In some embodiments, the TL1A binding protein disclosed herein is administered intravenously or subcutaneously. In some embodiments, the TL1A binding protein disclosed herein is administered intravenously. In some embodiments, the TL1A binding protein disclosed herein is administered subcutaneously.

Useful formulations can be prepared by methods known in the pharmaceutical art. For example, see Remington's Pharmaceutical Sciences, 18th ed. (Mack Publishing Company, 1990). Formulation components suitable for parenteral administration include a sterile diluent such as water for injection, saline solution, fixed oils, polyethylene glycols, glycerin, propylene glycol or other synthetic solvents; antibacterial agents such as benzyl alcohol or methyl parabens; antioxidants such as ascorbic acid or sodium bisulfite; chelating agents such as EDTA; buffers such as acetates, citrates or phosphates; and agents for the adjustment of tonicity such as sodium chloride or dextrose. In some embodiments, a pharmaceutical composition is an injectable liquid formulation. In some embodiments, the formulation for parenteral administration is citrate-free. In some embodiments, the injectable liquid formulation comprises one or more of: histidine; arginine or a salt thereof; EDTA; and polysorbate 80. In some embodiments, the injectable liquid formulation comprises one or more of: histidine; arginine or a salt thereof: EDTA; and poloxamer 188.

In some embodiments, the injectable dosage form comprises at least about 100 mg/ml, at least about 150 mg/ml, at least about 180 mg/ml, or at least about 200 mg/ml of the $\alpha4\beta7$ binding antibody. For example, the injectable dosage form comprises from at least about 100 mg/ml to at least 110 mg/ml, from at least about 110 mg/ml to at least 120 mg/ml, from at least about 120 mg/ml to at least 130 mg/ml, from at least about 130 mg/ml to at least 140 mg/ml, from at least about 140 mg/ml to at least 150 mg/ml, from at least about 150 mg/ml to at least 160 mg/ml, from at least about 160 mg/ml to at least 170 mg/ml, from at least about 170 mg/ml to at least 180 mg/ml, from at least about 180 mg/ml to at least 190 mg/ml, from at least about 190 mg/ml to at least 200 mg/ml, from at least about 200 mg/ml to at least 210 mg/ml or more of the TL1A binding protein described herein.

For intravenous or subcutaneous administration, suitable carriers include physiological saline, bacteriostatic water, Cremophor ELTM (BASF, Parsippany, NJ) or phosphate buffered saline (PBS). The carrier should be stable under the conditions of manufacture and storage, and should be preserved against microorganisms. The carrier can be a solvent or dispersion medium containing, for example, water, ethanol, polyol (for example, glycerol, propylene glycol, and liquid polyetheylene glycol), and suitable mixtures thereof.

An intravenous or subcutaneous drug delivery formulation may be contained in a syringe, pen, or bag. In some embodiments, the bag is connected to a channel comprising a tube and/or a needle. In some embodiments, the formulation is a lyophilized formulation or a liquid formulation. Various devices can be used to deliver liquid formulations by subcutaneous route of administration, including on-body infusion devices, autoinjector devices, prefilled syringes, and syringes. Generally, administration time depends on volume and device, and can range from seconds to minutes.

These compositions may be sterilized by conventional sterilization techniques, or may be sterile filtered. The resulting aqueous solutions may be packaged for use as-is, or lyophilized, the lyophilized preparation being combined with a sterile aqueous carrier prior to administration.

A polyol, which acts as a tonicifier and may stabilize the TL1A binding protein, may also be included in the formulation. The polyol is added to the formulation in an amount which may vary with respect to the desired isotonicity of the formulation. In some embodiments, the aqueous formulation is isotonic. The amount of polyol added may also be altered with respect to the molecular weight of the polyol. For example, a lower amount of a monosaccharide (e.g., mannitol) is added, compared to a disaccharide (such as trehalose). In some embodiments, the polyol which is used in the formulation as a tonicity agent is mannitol.

A detergent or surfactant may also be added to the formulation. Exemplary detergents include nonionic detergents such as polysorbates (e.g., polysorbates 20, 80 etc.) or poloxamers (e.g., poloxamer 188). The amount of detergent added is such that it reduces aggregation of the formulated antibody and/or minimizes the formation of particulates in the formulation and/or reduces adsorption. In some embodiments, the formulation may include a surfactant which is a polysorbate. In some embodiments, the formulation may contain the detergent polysorbate 80 or Tween 80. Tween 80 is a term used to describe polyoxyethylene (20) sorbitanmonooleate (see Fiedler, Lexikon der Hifsstoffe, Editio Cantor Verlag Aulendorf, 4th edi., 1996).

In embodiments, the protein product of the present disclosure is formulated as a liquid formulation. In some embodiments, the liquid formulation is prepared in combination with a sugar at stabilizing levels. In some embodiments, the liquid formulation is prepared in an aqueous carrier. In some embodiments, a stabilizer is added in an amount no greater than that which may result in a viscosity undesirable or unsuitable for intravenous administration. In some embodiments, the sugar is disaccharides, e.g., sucrose. In some embodiments, the liquid formulation may also include one or more of a buffering agent, a surfactant, and a preservative.

In some embodiments, the pH of the liquid formulation is set by addition of a pharmaceutically acceptable acid and/or base. In some embodiments, the pharmaceutically acceptable acid is hydrochloric acid. In some embodiments, the base is sodium hydroxide.

The aqueous carrier of interest herein is one which is pharmaceutically acceptable (safe and non-toxic for administration to a human) and is useful for the preparation of a liquid formulation. Illustrative carriers include sterile water for injection (SWFI), bacteriostatic water for injection (BWFI), a pH buffered solution (e.g., phosphate-buffered saline), sterile saline solution, Ringer's solution or dextrose solution.

A preservative may be optionally added to the formulations herein to reduce bacterial action. The addition of a preservative may, for example, facilitate the production of a multi-use (multiple-dose) formulation.

The TL1A binding protein may be lyophilized to produce a lyophilized formulation including the proteins and a lyoprotectant. The lyoprotectant may be sugar, e.g., disaccharides. In some embodiments, the lyoprotectant is sucrose or maltose. The lyophilized formulation may also include one or more of a buffering agent, a surfactant, a bulking agent, and/or a preservative.

The amount of sucrose or maltose useful for stabilization of the lyophilized drug product may be in a weight ratio of at least 1:2 protein to sucrose or maltose. In some embodiments, the protein to sucrose or maltose weight ratio is of from 1:2 to 1:5. In some embodiments, the pH of the formulation, prior to lyophilization, is set by addition of a pharmaceutically acceptable acid and/or base. In some embodiments, the pharmaceutically acceptable acid is hydrochloric acid. In some embodiments, the pharmaceutically acceptable base is sodium hydroxide.

A patient's dose can be tailored to the approximate body weight or surface area of the patient. Other factors in determining the appropriate dosage can include the disease or condition to be treated or prevented, the severity of the disease, the route of administration, and the age, sex, and medical condition of the patient. Further refinement of the calculations necessary to determine the appropriate dosage for treatment is routinely made by those skilled in the art, especially in light of the dosage information and assays disclosed herein. The dosage can also be determined through the use of known assays for determining dosages used in conjunction with appropriate dose-response data. An individual patient's dosage can be adjusted as the progress of the disease is monitored. Blood levels of the targetable construct or complex in a patient can be measured to see if the dosage needs to be adjusted to reach or maintain an effective concentration. Pharmacogenomics may be used to determine which targetable constructs and/or complexes, and dosages thereof, are most likely to be effective for a given individual (Schmitz et al., Clinica Chimica Acta 308:43-53, 2001: Steimer et al., Clinica Chimica Acta 308:33-41, 2001).

Methods of Preparation

The TL1A binding proteins described above can be made using recombinant DNA technology well known to a skilled person in the art. For example, one or more isolated polynucleotides encoding the TL1A binding protein can be ligated to other appropriate nucleotide sequences, including, for example, constant region coding sequences, and expression control sequences, to produce conventional gene expression constructs (i.e., expression vectors) encoding the desired TL1A binding proteins, Production of defined gene constructs is within routine skill in the art.

Nucleic acids encoding desired TL1A binding proteins are provided herein. Nucleic acids encoding desired TL1A binding proteins can be incorporated (ligated) into expression vectors, which can be introduced into host cells through conventional transfection or transformation techniques. Exemplary host cells are *E. coli* cells, Chinese hamster ovary (CHO) cells, human embryonic kidney 293 (HEK 293) cells, HeLa cells, baby hamster kidney (BHK) cells, monkey kidney cells (COS), human hepatocellular carcinoma cells (e.g., Hep G2), and myeloma cells that do not otherwise produce IgG protein. Transformed host cells can be grown under conditions that permit the host cells to express the genes that encode TL1A binding proteins. In some embodiments, the nucleic acid comprises a sequence as set forth in SEQ ID NOs: 2586-2595.

| SEQ ID NO | Antibody |
|---|---|
| 2586 | Antibody 10 Heavy Chain (HC) |
| 2587 | Antibody 10 Light Chain (LC) |
| 2588 | Antibody 19 Heavy Chain (HC) |
| 2589 | Antibody 19 Light Chain (LC) |
| 2590 | Antibody 47 Heavy Chain (HC) |
| 2591 | Antibody 47 Light Chain (LC) |
| 2592 | Antibody 63 Heavy Chain (HC) |
| 2593 | Antibody 63 Light Chain (LC) |
| 2594 | Antibody 86 Heavy Chain (HC) |
| 2595 | Antibody 86 Light Chain (LC) |

Specific expression and purification conditions will vary depending upon the expression system employed. For example, if a gene is to be expressed in *E. coli*, it is first cloned into an expression vector by positioning the engineered gene downstream from a suitable bacterial promoter, e.g., Trp or Tac, and a prokaryotic signal sequence. The expressed protein may be secreted. The expressed protein may accumulate in refractile or inclusion bodies, which can be harvested after disruption of the cells by French press or sonication. The refractile bodies then are solubilized, and the protein may be refolded and/or cleaved by methods known in the art.

If the engineered gene is to be expressed in eukaryotic host cells, e.g., CHO cells, it is first inserted into an expression vector containing a suitable eukaryotic promoter, a secretion signal, a poly A sequence, and a stop codon. Optionally, the vector or gene construct may contain enhancers and introns. In embodiments involving fusion proteins comprising an TL1A binding protein or portion thereof, the expression vector optionally contains sequences encoding all or part of a constant region, enabling an entire, or a part of, a heavy or light chain to be expressed. The gene construct can be introduced into eukaryotic host cells using conventional techniques.

In some embodiments, in order to express an TL1A binding protein, an N-terminal signal sequence is included in the protein construct. Exemplary N-terminal signal sequences include signal sequences from interleukin-2, CD-5, IgG kappa light chain, trypsinogen, serum albumin, and prolactin.

After transfection, single clones can be isolated for cell bank generation using methods known in the art, such as limited dilution, ELISA, FACS, microscopy, or Clonepix. Clones can be cultured under conditions suitable for bioreactor scale-up and maintained expression of the TL1A binding proteins.

The TL1A binding proteins can be isolated and purified using methods known in the art including centrifugation, depth filtration, cell lysis, homogenization, freeze-thawing, affinity purification, gel filtration, ion exchange chromatography, hydrophobic interaction exchange chromatography, and mixed-mode chromatography.

In some embodiments, the titer for the TL1A antibodies ranges from about 7 g/L about 8 g/L, about 9 g/L, about 10 g/L or more. In some embodiments, the yield ranges from about 70%, about 80%, about 90% or more.

In some embodiments, are methods for producing the TL1A binding protein described herein, the method comprising expressing the TL1A binding protein in a host cell and isolating the expressed TL1A binding protein.

In some embodiments, are methods for producing a TL1A binding protein that specifically binds to a TL1A polypeptide comprising SEQ ID NO: 2493 or 2494. In some embodiments, are methods for producing a TL1A binding protein that specifically binds to a TL1A polypeptide comprising SEQ ID NO: 2493 at any one of amino acid residues of Table 12. In some embodiments, are methods for producing a TL1A binding protein that specifically binds to a TL1A polypeptide comprising SEQ ID NO: 2493 at any one of amino acid residues of Table 13. In some embodiments, are methods for producing a TL1A binding protein that specifically binds to a TL1A polypeptide comprising SEQ ID NO: 2493 at any one of amino acid residues of Table 14. In some embodiments, are methods for producing a TL1A binding protein that specifically binds to a TL1A polypeptide comprising SEQ ID NO: 2493 at any one of amino acid residues of Val 102, Arg 103, Gln 104, Glu 120, Glu 122, Leu 123, and Arg 156, and Tyr 238, wherein the TL1A antigen binding protein is an antibody. In some embodiments, the TL1A binding protein specifically binds to the TL1A sequences at amino acid residues Lys243, Lys240, Thr239, Tyr238, Asp237, Val236, Leu235, Ser234, Ile233, Asp232, Met158, Arg156, Trp119, His118, Lys111, Phe110, His109, Gln108, Thr107, Pro106, Thr105, Gln104, Arg103, Val102, and Val101. In some embodiments, the TL1A binding protein specifically binds to the TL1A sequences at amino acid residues Lys240, Thr239, Tyr238, Asp237, Val236, Leu235, Ser234, Gln104, and Arg103, Val102, and Val101.

In some embodiments, are methods to obtain an antibody that specifically binds to a certain epitope portion of a TL1A sequence comprising SEQ ID NO: 2493 or 2494. In some embodiments, the method comprises assessing whether an antibody binds specifically to the certain epitope portion, wherein the certain epitope portion has amino acid residues Val 102, Arg 103, Gln 104, Thr 105, Thr 107, Gln 108, His 118, Trp 119, Glu 120, Glu 122, Leu 123, Gly 124, Lys 137, Arg 156, Gly 157, Met 158, Ser 25 227, Tyr 231, and Thr 232 of SEQ ID NO: 2493, and isolating or selecting the an antibody that binds to the certain epitope portion.

Specific Embodiments

Non-limiting specific embodiments are described below; each of which is considered to be within the present disclosure.

Embodiment 1. A TL1A binding protein comprising:

a) a heavy chain variable region (VH) comprising (i) a CDR1 having an amino acid sequence according to any one of SEQ ID NOs: 1-4 and 313-421, (ii) a CDR2 having an amino acid sequence according to any one of SEQ ID NOs: 11-14 and 422-530, and (iii) a CDR3 having an amino acid sequence according to any one of SEQ ID NOs: 21-24 and 531-639; and b) a light chain variable region (VL) comprising (i) a CDR1 having an amino acid sequence according to any one of SEQ ID NOs: 31-34 and 640-748, (ii) a CDR2 having an amino acid sequence according to any one of SEQ ID NOs: 41-44 and 749-857, and (iii) a CDR3 having an amino acid sequence according to any one of SEQ ID NOs: 51-54 and 858-966.

Embodiment 2. The TL1A binding protein of embodiment 1, wherein the VH comprises a sequence having at least 80% sequence identity to the amino acid sequence of any one of SEQ ID NOs: 181-184 and 2275-2383 and the VL comprises a sequence having at least 80% sequence identity to the amino acid sequence of any one of SEQ ID NOs: 191-194 and 2384-2492.

Embodiment 3. The TL1A binding protein of any one of embodiments 1-2, wherein the TL1A binding protein comprises a Fc domain.

Embodiment 4. The TL1A binding protein of embodiment 3, wherein the Fc domain is an IgG1, IgG2 or IgG4 immunoglobulin Fc domain.

Embodiment 5. The TL1A binding protein of embodiment 3, wherein the Fc domain is an IgG1 immunoglobulin domain.

Embodiment 6. The TL1A binding protein of embodiment 3, wherein the Fc domain is an IgG2 immunoglobulin domain.

Embodiment 7. The TL1A binding protein of embodiment 3, wherein the Fc domain is an IgG4 immunoglobulin domain.

Embodiment 8. The TL1A binding protein of any one of embodiments 3-7, wherein the Fc domain amino acid comprises amino acid modifications L234A/L235A (LALA) and/or M252Y, S254T, and T256E (YTE).

Embodiment 9. A TL1A binding protein comprising:

a) a heavy chain variable region (VH) comprising (i) a CDR1 having an amino acid sequence according to SEQ ID NO: 1, (ii) a CDR2 having an amino acid sequence according to SEQ ID NO: 11, and (iii) a CDR3 having an amino acid sequence according to SEQ ID NO: 21; and b) a light chain variable region (VL) comprising (i) a CDR1 having an amino acid sequence according to SEQ ID NO: 31, (ii) a CDR2 having an amino acid sequence according to SEQ ID NO: 41, and (iii) a CDR3 having an amino acid sequence according to SEQ ID NO: 51.

Embodiment 10. The TL1A binding protein of embodiment 9, wherein the VH comprises a sequence having at least 80% sequence identity to the amino acid sequence of SEQ ID NO: 181 and the VL comprises a sequence having at least 80% sequence identity to the amino acid sequence of SEQ ID NO: 191.

Embodiment 11. The TL1A binding protein of any one of embodiments 9-10, wherein the TL1A binding protein comprises a Fc domain comprising amino acid modifications L234A/L235A (LALA) and/or M252Y, S254T, and T256E (YTE).

Embodiment 12. A TL1A binding protein comprising:

a) a heavy chain variable region (VH) comprising (i) a CDR1 having an amino acid sequence according to SEQ ID NO: 2, (ii) a CDR2 having an amino acid sequence according to SEQ ID NO: 12, and (iii) a CDR3 having an amino acid sequence according to SEQ ID NO: 22; and b) a light chain variable region (VL) comprising (i) a CDR1 having an amino acid sequence according to SEQ ID NO: 32, (ii) a CDR2 having an amino acid sequence according to SEQ ID NO: 42, and (iii) a CDR3 having an amino acid sequence according to SEQ ID NO: 52.

Embodiment 13. The TL1A binding protein of embodiment 12, wherein the VH comprises a sequence having at least 80% sequence identity to the amino acid sequence of SEQ ID NO: 182 and the VL comprises a sequence having at least 80% sequence identity to the amino acid sequence of SEQ ID NO: 192.

Embodiment 14. The TL1A binding protein of any one of embodiments 12-13, wherein the TL1A binding protein comprises a Fc domain comprising amino acid modifications L234A/L235A (LALA) and/or M252Y, S254T, and T256E (YTE).

Embodiment 15. A TL1A binding protein comprising:

a) a heavy chain variable region (VH) comprising (i) a CDR1 having an amino acid sequence according to SEQ ID NO: 3, (ii) a CDR2 having an amino acid sequence according to SEQ ID NO: 13, and (iii) a CDR3 having an amino acid sequence according to SEQ ID NO: 23; and b) a light chain variable region (VL) comprising (i) a CDR1 having an amino acid sequence according to SEQ ID NO: 33, (ii) a CDR2 having an amino acid sequence according to SEQ ID NO: 43, and (iii) a CDR3 having an amino acid sequence according to SEQ ID NO: 53.

Embodiment 16. The TL1A binding protein of embodiment 15, wherein the VH comprises a sequence having at least 80% sequence identity to the amino acid sequence of SEQ ID NO: 183 and the VL comprises a sequence having at least 80% sequence identity to the amino acid sequence of SEQ ID NO: 193.

Embodiment 17. The TL1A binding protein of any one of embodiments 15-16, wherein the TL1A binding protein comprises a Fc domain comprising amino acid modifications L234A/L235A (LALA) and/or M252Y, S254T, and T256E (YTE).

Embodiment 18. A TL1A binding protein comprising:

a) a heavy chain variable region (VH) comprising (i) a CDR1 having an amino acid sequence according to SEQ ID NO: 4, (ii) a CDR2 having an amino acid sequence according to SEQ ID NO: 14, and (iii) a CDR3 having an amino acid sequence according to SEQ ID NO: 24; and b) a light chain variable region (VL) comprising (i) a CDR1 having an amino acid sequence according to SEQ ID NO: 34, (ii) a CDR2 having an amino acid sequence according to SEQ ID NO: 44, and (iii) a CDR3 having an amino acid sequence according to SEQ ID NO: 54. 30

Embodiment 19. The TL1A binding protein of embodiment 18, wherein the VH comprises a sequence having at least 80% sequence identity to the amino acid sequence of SEQ ID NO: 184 and the VL comprises a sequence having at least 80% sequence identity to the amino acid sequence of SEQ ID NO: 194.

Embodiment 20. The TL1A binding protein of any one of embodiments 18-19, wherein the TL1A binding protein comprises a Fc domain comprising amino acid modifications L234A/L235A (LALA) and/or M252Y, S254T, and T256E (YTE).

Embodiment 21. A TL1A binding protein comprising:

a) a heavy chain variable region (VH) comprising (i) a CDR1 having an amino acid sequence according to SEQ ID NO: 321, (ii) a CDR2 having an amino acid sequence according to SEQ ID NO: 430, and (iii) a CDR3 having an amino acid sequence according to SEQ ID NO: 539; and b) a light chain variable region (VL) comprising (i) a CDR1 having an amino acid sequence according to SEQ ID NO: 648, (ii) a CDR2 having an amino acid sequence according to SEQ ID NO: 757, and (iii) a CDR3 having an amino acid sequence according to SEQ ID NO: 866.

Embodiment 22. The TL1A binding protein of embodiment 21, wherein the VH comprises a sequence having at least 80% sequence identity to the amino acid sequence of SEQ ID NO: 2283 and the VL comprises a sequence having at least 80% sequence identity to the amino acid sequence of SEQ ID NO: 2392.

Embodiment 23. The TL1A binding protein of any one of embodiments 21-22, wherein the TL1A binding protein comprises a Fc domain comprising amino acid modifications L234A/L235A (LALA) and/or M252Y, S254T, and T256E (YTE).

Embodiment 24. A TL1A binding protein comprising:

a) a heavy chain variable region (VH) comprising (i) a CDR1 having an amino acid sequence according to SEQ ID NO: 341, (ii) a CDR2 having an amino acid sequence according to SEQ ID NO: 450, and (iii) a CDR3 having an amino acid sequence according to SEQ ID NO: 559; and b) a light chain variable region (VL) comprising (i) a CDR1 having an amino acid sequence according to SEQ ID NO: 668, (ii) a CDR2 having an amino acid sequence according to SEQ ID NO: 777, and (iii) a CDR3 having an amino acid sequence according to SEQ ID NO: 886.

Embodiment 25. The TL1A binding protein of embodiment 24, wherein the VH comprises a sequence having at least 80% sequence identity to the amino acid sequence of SEQ ID NO: 2303 and the VL comprises a sequence having at least 80% sequence identity to the amino acid sequence of SEQ ID NO: 2412.

Embodiment 26. The TL1A binding protein of any one of embodiments 24-25, wherein the TL1A binding protein comprises a Fc domain comprising amino acid modifications L234A/L235A (LALA) and/or M252Y, S254T, and T256E (YTE).

Embodiment 27. A TL1A binding protein comprising:

a) a heavy chain variable region (VH) comprising (i) a CDR1 having an amino acid sequence according to SEQ ID NO: 345, (ii) a CDR2 having an amino acid sequence according to SEQ ID NO: 454, and (iii) a CDR3 having an amino acid sequence according to SEQ ID NO: 563; and b) a light chain variable region (VL) comprising (i) a CDR1 having an amino acid sequence according to SEQ ID NO: 672, (ii) a CDR2 having an amino acid sequence according to SEQ ID NO: 781, and (iii) a CDR3 having an amino acid sequence according to SEQ ID NO: 890.

Embodiment 28. The TL1A binding protein of embodiment 27, wherein the VH comprises a sequence having at least 80% sequence identity to the amino acid sequence of SEQ ID NO: 2307 and the VL comprises a sequence having at least 80% sequence identity to the amino acid sequence of SEQ ID NO: 2416.

Embodiment 29. The TL1A binding protein of any one of embodiments 27-28, wherein the TL1A binding protein comprises a Fc domain comprising amino acid modifications L234A/L235A (LALA) and/or M252Y, S254T, and T256E (YTE).

Embodiment 30. A TL1A binding protein comprising:

a) a heavy chain variable region (VH) comprising (i) a CDR1 having an amino acid sequence according to SEQ ID NO: 349, (ii) a CDR2 having an amino acid sequence according to SEQ ID NO: 458, and (iii) a CDR3 having an amino acid sequence according to SEQ ID NO: 567; and b) a light chain variable region (VL) comprising (i) a CDR1 having an amino acid sequence according to SEQ ID NO: 676, (ii) a CDR2 having an amino acid sequence according to SEQ ID NO: 785, and (iii) a CDR3 having an amino acid sequence according to SEQ ID NO: 894.

Embodiment 31. The TL1A binding protein of embodiment 30, wherein the VH comprises a sequence having at least 80% sequence identity to the amino acid sequence of SEQ ID NO: 2311 and the VL comprises a sequence having at least 80% sequence identity to the amino acid sequence of SEQ ID NO: 2420.

Embodiment 32. The TL1A binding protein of any one of embodiments 30-31, wherein the TL1A binding protein comprises a Fc domain comprising amino acid modifications L234A/L235A (LALA) and/or M252Y, S254T, and T256E (YTE).

Embodiment 33. A TL1A binding protein comprising:

a) a heavy chain variable region (VH) comprising (i) a CDR1 having an amino acid sequence according to SEQ ID NO: 351, (ii) a CDR2 having an amino acid sequence according to SEQ ID NO: 460, and (iii) a CDR3 having an amino acid sequence according to SEQ ID NO: 569; and b) a light chain variable region (VL) comprising (i) a CDR1 having an amino acid sequence according to SEQ ID NO: 678, (ii) a CDR2 having an amino acid sequence according to SEQ ID NO: 787, and (iii) a CDR3 having an amino acid sequence according to SEQ ID NO: 896.

Embodiment 34. The TL1A binding protein of embodiment 33, wherein the VH comprises a sequence having at least 80% sequence identity to the amino acid sequence of SEQ ID NO: 2313 and the VL comprises a sequence having at least 80% sequence identity to the amino acid sequence of SEQ ID NO: 2422.

Embodiment 35. The TL1A binding protein of any one of embodiments 33-34, wherein the TL1A binding protein comprises a Fc domain comprising amino acid modifications L234A/L235A (LALA) and/or M252Y, S254T, and T256E (YTE).

Embodiment 36. A TL1A binding protein comprising:

a) a heavy chain variable region (VH) comprising (i) a CDR1 having an amino acid sequence according to SEQ ID NO: 354, (ii) a CDR2 having an amino acid sequence according to SEQ ID NO: 463, and (iii) a CDR3 having an amino acid sequence according to SEQ ID NO: 572; and b) a light chain variable region (VL) comprising (i) a CDR1 having an amino acid sequence according to SEQ ID NO: 681, (ii) a CDR2 having an amino acid sequence according to SEQ ID NO: 790, and (iii) a CDR3 having an amino acid sequence according to SEQ ID NO: 899.

Embodiment 37. The TL1A binding protein of embodiment 36, wherein the VH comprises a sequence having at least 80% sequence identity to the amino acid sequence of SEQ ID NO: 2316 and the VL comprises a sequence having at least 80% sequence identity to the amino acid sequence of SEQ ID NO: 2425.

Embodiment 38. The TL1A binding protein of any one of embodiments 36-37, wherein the TL1A binding protein comprises a Fc domain comprising amino acid modifications L234A/L235A (LALA) and/or M252Y, S254T, and T256E (YTE).

Embodiment 39. A TL1A binding protein comprising:

a) a heavy chain variable region (VH) comprising (i) a CDR1 having an amino acid sequence according to SEQ ID NO: 365, (ii) a CDR2 having an amino acid sequence according to SEQ ID NO: 474, and (iii) a CDR3 having an amino acid sequence according to SEQ ID NO: 583; and b) a light chain variable region (VL) comprising (i) a CDR1 having an amino acid sequence according to SEQ ID NO: 692, (ii) a CDR2 having an amino acid sequence according to SEQ ID NO: 801, and (iii) a CDR3 having an amino acid sequence according to SEQ ID NO: 910.

Embodiment 40. The TL1A binding protein of embodiment 39, wherein the VH comprises a sequence having at least 80% sequence identity to the amino acid sequence of SEQ ID NO: 2327 and the VL comprises a sequence having at least 80% sequence identity to the amino acid sequence of SEQ ID NO: 2436.

Embodiment 41. The TL1A binding protein of any one of embodiments 39-40, wherein the TL1A binding protein comprises a Fc domain comprising amino acid modifications L234A/L235A (LALA) and/or M252Y, S254T, and T256E (YTE).

Embodiment 42. A TL1A binding protein comprising:

a) a heavy chain variable region (VH) comprising (i) a CDR1 having an amino acid sequence according to SEQ ID NO: 371, (ii) a CDR2 having an amino acid sequence according to SEQ ID NO: 480, and (iii) a CDR3 having an amino acid sequence according to SEQ ID NO: 589; and b) a light chain variable region (VL) comprising (i) a CDR1 having an amino acid sequence according to SEQ ID NO: 698, (ii) a CDR2 having an amino acid sequence according to SEQ ID NO: 807, and (iii) a CDR3 having an amino acid sequence according to SEQ ID NO: 916.

Embodiment 43. The TL1A binding protein of embodiment 42, wherein the VH comprises a sequence having at least 80% sequence identity to the amino acid sequence of SEQ ID NO: 2333 and the VL comprises a sequence having at least 80% sequence identity to the amino acid sequence of SEQ ID NO: 2442.

Embodiment 44. The TL1A binding protein of any one of embodiments 42-43, wherein the TL1A binding protein comprises a Fc domain comprising amino acid modifications L234A/L235A (LALA) and/or M252Y, S254T, and T256E (YTE).

Embodiment 45. A TL1A binding protein comprising:

a) a heavy chain variable region (VH) comprising (i) a CDR1 having an amino acid sequence according to SEQ ID NO: 372, (ii) a CDR2 having an amino acid sequence according to SEQ ID NO: 481, and (iii) a CDR3 having an amino acid sequence according to SEQ ID NO: 590; and b) a light chain variable region (VL) comprising (i) a CDR1 having an amino acid sequence according to SEQ ID NO: 699, (ii) a CDR2 having an amino acid sequence according to SEQ ID NO: 808, and (iii) a CDR3 having an amino acid sequence according to SEQ ID NO: 917.

Embodiment 46. The TL1A binding protein of embodiment 45, wherein the VH comprises a sequence having at least 80% sequence identity to the amino acid sequence of SEQ ID NO: 2334 and the VL comprises a sequence having at least 80% sequence identity to the amino acid sequence of SEQ ID NO: 2443.

Embodiment 47. The TL1A binding protein of any one of embodiments 45-46, wherein the TL1A binding protein comprises a Fc domain comprising amino acid modifications L234A/L235A (LALA) and/or M252Y, S254T, and T256E (YTE).

Embodiment 48. A TL1A binding protein comprising:

a) a heavy chain variable region (VH) comprising (i) a CDR1 having an amino acid sequence according to SEQ ID NO: 373, (ii) a CDR2 having an amino acid sequence according to SEQ ID NO: 482, and (iii) a CDR3 having an amino acid sequence according to SEQ ID NO: 591; and b) a light chain variable region (VL) comprising (i) a CDR1 having an amino acid sequence according to SEQ ID NO: 700, (ii) a CDR2 having an amino acid sequence according to SEQ ID NO: 809, and (iii) a CDR3 having an amino acid sequence according to SEQ ID NO: 918.

Embodiment 49. The TL1A binding protein of embodiment 48, wherein the VH comprises a sequence having at least 80% sequence identity to the amino acid sequence of SEQ ID NO: 2335 and the VL comprises a sequence having at least 80% sequence identity to the amino acid sequence of SEQ ID NO: 2444.

Embodiment 50. The TL1A binding protein of any one of embodiments 48-49, wherein the TL1A binding protein comprises a Fc domain comprising amino acid modifications L234A/L235A (LALA) and/or M252Y, S254T, and T256E (YTE).

Embodiment 51. A TL1A binding protein comprising:

a) a heavy chain variable region (VH) comprising (i) a CDR1 having an amino acid sequence according to SEQ ID NO: 388, (ii) a CDR2 having an amino acid sequence according to SEQ ID NO: 497, and (iii) a CDR3 having an amino acid sequence according to SEQ ID NO: 606; and b) a light chain variable region (VL) comprising (i) a CDR1 having an amino acid sequence according to SEQ ID NO: 715, (ii) a CDR2 having an amino acid sequence according to SEQ ID NO: 824, and (iii) a CDR3 having an amino acid sequence according to SEQ ID NO: 933.

Embodiment 52. The TL1A binding protein of embodiment 51, wherein the VH comprises a sequence having at least 80% sequence identity to the amino acid sequence of SEQ ID NO: 2350 and the VL comprises a sequence having at least 80% sequence identity to the amino acid sequence of SEQ ID NO: 2459.

Embodiment 53. The TL1A binding protein of any one of embodiments 51-52, wherein the TL1A binding protein comprises a Fc domain comprising amino acid modifications L234A/L235A (LALA) and/or M252Y, S254T, and T256E (YTE).

Embodiment 54. A TL1A binding protein comprising:

a) a heavy chain variable region (VH) comprising (i) a CDR1 having an amino acid sequence according to SEQ ID NO: 394, (ii) a CDR2 having an amino acid sequence according to SEQ ID NO: 503, and (iii) a CDR3 having an amino acid sequence according to SEQ ID NO: 612; and b) a light chain variable region (VL) comprising (i) a CDR1 having an amino acid sequence according to SEQ ID NO: 721, (ii) a CDR2 having an amino acid sequence according to SEQ ID NO: 830, and (iii) a CDR3 having an amino acid sequence according to SEQ ID NO: 939.

Embodiment 55. The TL1A binding protein of embodiment 54, wherein the VH comprises a sequence having at least 80% sequence identity to the amino acid sequence of SEQ ID NO: 2356 and the VL comprises a sequence having at least 80% sequence identity to the amino acid sequence of SEQ ID NO: 2465.

Embodiment 56. The TL1A binding protein of any one of embodiments 54-55, wherein the TL1A binding protein comprises a Fc domain comprising amino acid modifications L234A/L235A (LALA) and/or M252Y, S254T, and T256E (YTE).

Embodiment 57. A TL1A binding protein comprising:

a) a heavy chain variable region (VH) comprising (i) a CDR1 having an amino acid sequence according to SEQ ID NO: 400, (ii) a CDR2 having an amino acid sequence according to SEQ ID NO: 509, and (iii) a CDR3 having an amino acid sequence according to SEQ ID NO: 618; and b) a light chain variable region (VL) comprising (i) a CDR1 having an amino acid sequence according to SEQ ID NO: 727, (ii) a CDR2 having an amino acid sequence according to SEQ ID NO: 836, and (iii) a CDR3 having an amino acid sequence according to SEQ ID NO: 945.

Embodiment 58. The TL1A binding protein of embodiment 57, wherein the VH comprises a sequence having at least 80% sequence identity to the amino acid sequence of SEQ ID NO: 2362 and the VL comprises a sequence having at least 80% sequence to SEQ ID NO: 2471.

Embodiment 59. The TL1A binding protein of any one of embodiments 57-58, wherein the TL1A binding protein comprises a Fc domain comprising amino acid modifications L234A/L235A (LALA) and/or M252Y, S254T, and T256E (YTE).

Embodiment 60. A TL1A binding protein comprising:

a) a heavy chain variable region (VH) comprising (i) a CDR1 having an amino acid sequence according to any one of SEQ ID NOs: 1-4 and 313-421, (ii) a CDR2 having an amino acid sequence according to any one of SEQ ID NOs: 11-14 and 422-530, and (iii) a CDR3 having an amino acid sequence according to any one of SEQ ID NOs: 21-24 and 531-639;

b) a light chain variable region (VL) comprising (i) a CDR1 having an amino acid sequence according to any one of SEQ ID NOs: 31-34 and 640-748, (ii) a CDR2 having an amino acid sequence according to any one of SEQ ID NOs: 41-44 and 749-857, and (iii) a CDR3 having an amino acid sequence according to any one of SEQ ID NOs: 51-54 and 858-966; and c) a modified Fc that extends half-life of the TL1A binding protein as compared to a TL1A binding protein that does not comprise the modified Fc.

Embodiment 61. A TL1A binding protein, wherein the TL1A binding protein specifically binds to an epitope of TL1A and comprises a Fc domain comprising amino acid modifications L234A/L235A (LALA) and/or M252Y, S254T, and T256E (YTE).

Embodiment 62. A TL1A binding protein, wherein the TL1A binding protein specifically binds to a TL1A polypeptide comprising SEQ ID NO: 2493 or 2494, wherein the TL1A antigen binding protein is an antibody.

Embodiment 63. The TL1A binding protein of any one of embodiments 1-62, wherein the TL1A binding protein binds TL1A with a KD less than about 0.5 nanomolar (nM).

Embodiment 64. The TL1A binding protein of any one of embodiments 1-62, wherein the TL1A binding protein binds TL1A with a KD less than about 0.4 nanomolar (nM).

Embodiment 65. The TL1A binding protein of any one of embodiments 1-62, wherein the TL1A binding protein comprises a binding affinity to TL1A at least 2 fold more than a binding affinity of a comparator antibody to TL1A.

Embodiment 66. The TL1A binding protein of any one of embodiments 1-62, wherein the TL1A binding protein reduces TL1A-induced apoptosis by at least 2 fold more than a comparator antibody.

Embodiment 67. A method of treating an inflammatory bowel disease in an patient in need thereof, the method comprising subcutaneously or intravenously administering to the patient an effective amount of a TL1A binding protein of any one of embodiments 1-66.

Embodiment 68. The method of embodiment 67, wherein the inflammatory bowel disease is Crohn's disease or ulcerative colitis.

Embodiment 69. The method of embodiment 68, wherein the inflammatory bowel disease is ulcerative colitis.

Embodiment 70. The method of embodiment 68, wherein the inflammatory bowel disease is Crohn's disease.

Embodiment 71. The method of any one of embodiments 67-70, wherein administration of the TL1A binding protein is subcutaneous.

Embodiment 72. The method of any one of embodiments 67-70, wherein administration of the TL1A binding protein is intravenous.

Embodiment 73. A method of treating an inflammatory disease in an patient in need thereof, the method comprising subcutaneously or intravenously administering to the patient an effective amount of a TL1A binding protein of any one of embodiments 1-66.

Embodiment 74. The method of embodiment 73, wherein the inflammatory disease is psoriasis.

Embodiment 75. The method of embodiment 73, wherein the inflammatory disease is psoriatic arthritis.

Embodiment 76. The method of embodiment 73, wherein the inflammatory disease is hidradenitis suppurativa.

Embodiment 77. The method of any one of embodiments 73-76, wherein administration of the TL1A binding protein is subcutaneous.

Embodiment 78. The method of any one of embodiments 73-76, wherein administration of the TL1A binding protein is intravenous.

Embodiment 79. A method of treating an inflammatory bowel disease in a patient in need thereof, the method comprising subcutaneously or intravenously administering to the patient an effective amount of a TL1A antigen binding protein that specifically binds to a TL1A polypeptide comprising SEQ ID NO: 2493 or 2494, wherein the TL1A antigen binding protein is an antibody.

Embodiment 80. The method of embodiment 79, wherein the inflammatory bowel disease is Crohn's disease or ulcerative colitis.

Embodiment 81. The method of embodiment 80, wherein the inflammatory bowel disease is ulcerative colitis.

Embodiment 82. The method of embodiment 80, wherein the inflammatory bowel disease is Crohn's disease.

Embodiment 83. The method of any one of embodiments 79-82, wherein administration of the TL1A binding protein is subcutaneous.

Embodiment 84. The method of any one of embodiments 79-82, wherein administration of the TL1A binding protein is intravenous.

Embodiment 85. A method of treating an inflammatory disease in a patient in need thereof, the method comprising subcutaneously or intravenously administering to the patient an effective amount of a TL1A antigen binding protein that specifically binds to a TL1A polypeptide comprising SEQ ID NO: 2493 or 2494, wherein the TL1A antigen binding protein is an antibody characterized by:

binding to an epitope on TL1A recognized by an antibody disclosed herein, such as antibody 1, 2, 3, 4, 6, 8, 10, 47, 49, 63, or 69; or binding specifically to a TL1A polypeptide comprising SEQ ID NO: 2493 at any one of amino acid residues Val 101, Val 102, Arg 103, Gln 104, Thr 105, Pro 106, Thr 107, Gln 108, His 109, Phe 110, Lys 111, His 118, Trp 119, Glu 120, Glu 122, Leu 123, Gly 124, Lys 137, Arg 156, Gly 157, Met 158, Ser 231, Asp 232, Ile 233, Ser 234, Tyr 238, Thr 239, Lys 240, and Lys 243; or binding to the TL1A sequences at ten or more amino acid residues Val 102, Arg 103, Gln 104, Thr 105, Thr 107, Gln 108, His 118, Trp 119, Glu 120, Glu 122, Leu 123, Gly 124, Lys 137, Arg 156, Gly 157, Met 158, Ser 231, Asp 232, Ile 233, Ser 234, Leu 235, Val 236, Asp 237, Tyr 238, Thr 239, Lys 240, and Lys 243; or having a CDR sequence of an antibody of Table 1.1B; or having a having a heavy chain-light chain of an antibody of Table 2.1.

Embodiment 86. The method of embodiment 85, wherein the inflammatory disease is psoriasis.

Embodiment 87. The method of embodiment 85, wherein the inflammatory disease is psoriatic arthritis.

Embodiment 88. The method of embodiment 85, wherein the inflammatory disease is hidradenitis suppurativa.

Embodiment 89. The method of any one of embodiments 85-88, wherein administration of the TL1A binding protein is subcutaneous.

Embodiment 90. The method of any one of embodiments 85-88, wherein administration of the TL1A binding protein is intravenous.

Embodiment 91. A method for producing the TL1A binding protein of any one of embodiments 1-66, the method comprising expressing the TL1A binding protein in a host cell and isolating the expressed TL1A binding protein.

Embodiment 92. A method for producing a TL1A binding protein that specifically binds to a TL1A polypeptide comprising SEQ ID NO: 2493 or 2494, wherein the TL1A antigen binding protein is an antibody.

Embodiment 93. A method to obtain an antibody that specifically binds to a certain epitope portion of a TL1A sequence comprising SEQ ID NO: 2493 or 2494, wherein the method comprises assessing whether an antibody binds specifically to the certain epitope portion, and isolating or selecting the antibody that binds to the certain epitope portion.

Embodiment 94. A TL1A binding protein comprising:

a) a heavy chain variable region (VH) comprising (i) a CDR1 having an amino acid sequence according to any one of SEQ ID NOs: 5-10, (ii) a CDR2 having an amino acid sequence according to any one of SEQ ID NOs: 15-20, and (iii) a CDR3 having an amino acid sequence according to any one of SEQ ID NOs: 25-30; and b) a light chain variable region (VL) comprising (i) a CDR1 having an amino acid sequence according to any one of SEQ ID NOs: 35-40, (ii) a CDR2 having an amino acid sequence according to any one of SEQ ID NOs: 45-50, and (iii) a CDR3 having an amino acid sequence according to any one of SEQ ID NOs: 55-60.

Embodiment 95. The TL1A binding protein of embodiment 94, wherein the VH comprises a sequence having at least 80% sequence identity to the amino acid sequence of any one of SEQ ID NOs: 185-190 and the VL comprises a sequence having at least 80% sequence identity to the amino acid sequence of any one of SEQ ID NOs: 195-200.

Embodiment 96. The TL1A binding protein of any one of embodiments 94-95, wherein the TL1A binding protein comprises a Fc domain.

Embodiment 97. The TL1A binding protein of embodiment 96, wherein the Fc domain is an IgG1, IgG2 or IgG4 immunoglobulin Fc domain.

Embodiment 98. The TL1A binding protein of embodiment 96, wherein the Fc domain is an IgG1 immunoglobulin domain.

Embodiment 99. The TL1A binding protein of embodiment 96, wherein the Fc domain is an IgG2 immunoglobulin domain.

Embodiment 100. The TL1A binding protein of embodiment 96, wherein the Fc domain is an IgG4 immunoglobulin domain.

Embodiment 101. The TL1A binding protein of any one of embodiments 96-100, wherein the Fc domain amino acid comprises amino acid modifications L234A/L235A (LALA) and/or M252Y, S254T, and T256E (YTE).

Embodiment 102. A TL1A binding protein comprising:

a) a heavy chain variable region (VH) comprising (i) a CDR1 having an amino acid sequence according to SEQ ID NO: 5, (ii) a CDR2 having an amino acid sequence according to SEQ ID NO: 15, and (iii) a CDR3 having an amino acid sequence according to SEQ ID NO: 25; and b) a light chain variable region (VL) comprising (i) a CDR1 having an amino acid sequence according to SEQ ID NO: 35, (ii) a CDR2 having an amino acid sequence according to SEQ ID NO: 45, and (iii) a CDR3 having an amino acid sequence according to SEQ ID NO: 55.

Embodiment 103. The TL1A binding protein of embodiment 102, wherein the VH comprises a sequence having at least 80% sequence identity to the amino acid sequence of SEQ ID NO: 185 and the VL comprises a sequence having at least 80% sequence identity to the amino acid sequence of SEQ ID NO: 195.

Embodiment 104. The TL1A binding protein of any one of embodiments 102-103, wherein the TL1A binding protein comprises a Fc domain comprising amino acid modifications L234A/L235A (LALA) and/or M252Y, S254T, and T256E (YTE).

Embodiment 105. A TL1A binding protein comprising:

a) a heavy chain variable region (VH) comprising (i) a CDR1 having an amino acid sequence according to SEQ ID NO: 6, (ii) a CDR2 having an amino acid sequence according to SEQ ID NO: 16, and (iii) a CDR3 having an amino acid sequence according to SEQ ID NO: 26; and b) a light chain variable region (VL) comprising (i) a CDR1 having an amino acid sequence according to SEQ ID NO: 36, (ii) a CDR2 having an amino acid sequence according to SEQ ID NO: 46, and (iii) a CDR3 having an amino acid sequence according to SEQ ID NO: 56.

Embodiment 106. The TL1A binding protein of embodiment 105, wherein the VH comprises a sequence having at least 80% sequence identity to the amino acid sequence of SEQ ID NO: 186 and the VL comprises a sequence having at least 80% sequence identity to the amino acid sequence of SEQ ID NO: 196.

Embodiment 107. The TL1A binding protein of any one of embodiments 105-106, wherein the TL1A binding protein comprises a Fc domain comprising amino acid modifications L234A/L235A (LALA) and/or M252Y, S254T, and T256E (YTE).

Embodiment 108. A TL1A binding protein comprising:

a) a heavy chain variable region (VH) comprising (i) a CDR1 having an amino acid sequence according to SEQ ID NO: 7, (ii) a CDR2 having an amino acid sequence according to SEQ ID NO: 17, and (iii) a CDR3 having an amino acid sequence according to SEQ ID NO: 27; and b) a light chain variable region (VL) comprising (i) a CDR1 having an amino acid sequence according to SEQ ID NO: 37, (ii) a CDR2 having an amino acid sequence according to SEQ ID NO: 47, and (iii) a CDR3 having an amino acid sequence according to SEQ ID NO: 57.

Embodiment 109. The TL1A binding protein of embodiment 108, wherein the VH comprises a sequence having at least 80% sequence identity to the amino acid sequence of SEQ ID NO: 187 and the VL comprises a sequence having at least 80% sequence identity to the amino acid sequence of SEQ ID NO: 197.

Embodiment 110. The TL1A binding protein of any one of embodiments 108-109, wherein the TL1A binding protein comprises a Fc domain comprising amino acid modifications L234A/L235A (LALA) and/or M252Y, S254T, and T256E (YTE).

Embodiment 111. A TL1A binding protein comprising:

a) a heavy chain variable region (VH) comprising (i) a CDR1 having an amino acid sequence according to SEQ ID NO: 8, (ii) a CDR2 having an amino acid sequence according to SEQ ID NO: 18, and (iii) a CDR3 having an amino acid sequence according to SEQ ID NO: 28; and b) a light chain variable region (VL) comprising (i) a CDR1 having an amino acid sequence according to SEQ ID NO: 38, (ii) a CDR2 having an amino acid sequence according to SEQ ID NO: 48, and (iii) a CDR3 having an amino acid sequence according to SEQ ID NO: 58.

Embodiment 112. The TL1A binding protein of embodiment 111, wherein the VH comprises a sequence having at least 80% sequence identity to the amino acid sequence of SEQ ID NO: 188 and the VL comprises a sequence having at least 80% sequence identity to the amino acid sequence of SEQ ID NO: 198.

Embodiment 113. The TL1A binding protein of any one of embodiments 111-112, wherein the TL1A binding protein comprises a Fc domain comprising amino acid modifications L234A/L235A (LALA) and/or M252Y, S254T, and T256E (YTE).

Embodiment 114. A TL1A binding protein comprising:

a) a heavy chain variable region (VH) comprising (i) a CDR1 having an amino acid sequence according to SEQ ID NO: 9, (ii) a CDR2 having an amino acid sequence according to SEQ ID NO: 19, and (iii) a CDR3 having an amino acid sequence according to SEQ ID NO: 29; and b) a light chain variable region (VL) comprising (i) a CDR1 having an amino acid sequence according to SEQ ID NO: 39, (ii) a CDR2 having an amino acid sequence according to SEQ ID NO: 49, and (iii) a CDR3 having an amino acid sequence according to SEQ ID NO: 59.

Embodiment 115. The TL1A binding protein of embodiment 114, wherein the VH comprises a sequence having at least 80% sequence identity to the amino acid sequence of SEQ ID NO: 189 and the VL comprises a sequence having at least 80% sequence identity to the amino acid sequence of SEQ ID NO: 199.

Embodiment 116. The TL1A binding protein of any one of embodiments 114-115, wherein the TL1A binding protein comprises a Fc domain comprising amino acid modifications L234A/L235A (LALA) and/or M252Y, S254T, and T256E (YTE).

Embodiment 117. A TL1A binding protein comprising:

a) a heavy chain variable region (VH) comprising (i) a CDR1 having an amino acid sequence according to SEQ ID NO: 10, (ii) a CDR2 having an amino acid sequence according to SEQ ID NO: 20, and (iii) a CDR3 having an amino acid sequence according to SEQ ID NO: 30; and b) a light chain variable region (VL) comprising (i) a CDR1 having an amino acid sequence according to SEQ ID NO: 40, (ii) a CDR2 having an amino acid sequence according to SEQ ID NO: 50, and (iii) a CDR3 having an amino acid sequence according to SEQ ID NO: 60.

Embodiment 118. The TL1A binding protein of embodiment 117, wherein the VH comprises a sequence having at least 80% sequence identity to the amino acid sequence of SEQ ID NO: 190 and the VL comprises a sequence having at least 80% sequence identity to the amino acid sequence of SEQ ID NO: 200.

Embodiment 119. The TL1A binding protein of any one of embodiments 117-118, wherein the TL1A binding protein comprises a Fc domain comprising amino acid modifications L234A/L235A (LALA) and/or M252Y, S254T, and T256E (YTE).

Embodiment 120. A TL1A binding protein comprising:

a) a heavy chain variable region (VH) comprising (i) a CDR1 having an amino acid sequence according to any one of SEQ ID NOs: 5-10, (ii) a CDR2 having an amino acid sequence according to any one of SEQ ID NOs: 15-20, and (iii) a CDR3 having an amino acid sequence according to any one of SEQ ID NOs: 25-30;

b) a light chain variable region (VL) comprising (i) a CDR1 having an amino acid sequence according to any one of SEQ ID NOs: 35-40, (ii) a CDR2 having an amino acid sequence according to any one of SEQ ID NOs: 45-50, and (iii) a CDR3 having an amino acid sequence according to any one of SEQ ID NOs: 55-60; and c) a modified Fc that extends half-life of the TL1A binding protein as compared to a TL1A binding protein that does not comprise the modified Fc.

Embodiment 121. A TL1A binding protein, wherein the TL1A binding protein specifically binds to an epitope of TL1A and comprises a Fc domain comprising amino acid modifications L234A/L235A (LALA) and/or M252Y, S254T, and T256E (YTE).

Embodiment 122. A TL1A binding protein, wherein the TL1A binding protein specifically binds to a TL1A polypeptide comprising SEQ ID NO: 2493 at any one of amino acid residues Val 102, Arg 103, Gln 104, Thr 105, Thr 107, Gln 108, His 118, Trp 119, Glu 120, Glu 122, Leu 123, Gly 124, Lys 137, Arg 156, Gly 157, Met 158, Ser 227, Tyr 231, and Thr 232, wherein the TL1A antigen binding protein is an antibody.

Embodiment 123. The TL1A binding protein of embodiment 122, wherein the TL1A binding protein specifically binds to the TL1A sequences at amino acid residues Val 101, Val 102, Arg 103, Gln 104, Thr 105, Pro 106, Gln 108, His 118, Glu 120, Glu 122, Leu 123, Gly 124, Asn 136, Lys 137, Arg 156, Gly 157, Met 158, Ser 234, Tyr 238, Thr 239.

Embodiment 124. The TL1A binding protein of any one of embodiments 94-123, wherein the TL1A binding protein binds TL1A with a KD less than about 0.5 nanomolar (nM).

Embodiment 125. The TL1A binding protein of any one of embodiments 94-123, wherein the TL1A binding protein binds TL1A with a KD less than about 0.4 nanomolar (nM).

Embodiment 126. The TL1A binding protein of any one of embodiments 94-123, wherein the TL1A binding protein comprises a binding affinity to TL1A at least 2 fold more than a binding affinity of a comparator antibody to TL1A.

Embodiment 127. The TL1A binding protein of any one of embodiments 94-123, wherein the TL1A binding protein reduces TL1A-induced apoptosis by at least 2 fold more than a comparator antibody.

Embodiment 128. A method of treating an inflammatory bowel disease in a patient in need thereof, the method comprising subcutaneously or intravenously administering to the patient an effective amount of a TL1A binding protein of any one of embodiments 94-127.

Embodiment 129. The method of embodiment 128, wherein the inflammatory bowel disease is Crohn's disease or ulcerative colitis.

Embodiment 130. The method of embodiment 129, wherein the inflammatory bowel disease is ulcerative colitis.

Embodiment 131. The method of embodiment 129, wherein the inflammatory bowel disease is Crohn's disease.

Embodiment 132. The method of any one of embodiments 128-131, wherein administration of the TL1A binding protein is subcutaneous.

Embodiment 133. The method of any one of embodiments 128-131, wherein administration of the TL1A binding protein is intravenous.

Embodiment 134. A method of treating an inflammatory disease in an patient in need thereof, the method comprising subcutaneously or intravenously administering to the patient an effective amount of a TL1A binding protein of any one of embodiments 94-127.

Embodiment 135. The method of embodiment 134, wherein the inflammatory disease is psoriasis.

Embodiment 136. The method of embodiment 134, wherein the inflammatory disease is psoriatic arthritis.

Embodiment 137. The method of embodiment 134, wherein the inflammatory disease is hidradenitis suppurativa.

Embodiment 138. The method of any one of embodiments 134-137, wherein administration of the TL1A binding protein is subcutaneous.

Embodiment 139. The method of any one of embodiments 134-137, wherein administration of the TL1A binding protein is intravenous.

Embodiment 140. A method of treating an inflammatory bowel disease in an patient in need thereof, the method comprising subcutaneously or intravenously administering to the patient an effective amount of a TL1A antigen binding protein that specifically binds to a TL1A polypeptide comprising SEQ ID NO: 2493 at any one of amino acid residues Val 101, Val 102, Arg 103, Gln 104, Thr 105, Pro 106, Gln 108, His 118, Glu 120, Glu 122, Leu 123, Gly 124, Asn 136, Lys 137, Arg 156, Gly 157, Met 158, Ser 234, Tyr 238, Thr 239, wherein the TL1A antigen binding protein is an antibody.

Embodiment 141. The method of embodiment 140, wherein the TL1A antigen binding protein specifically binds to the TL1A sequences at amino acid residues Val 101, Val 102, Arg 103, Gln 104, Thr 105, Pro 106, Gln 108, His 118, Glu 120, Glu 122, Leu 123, Gly 124, Asn 136, Lys 137, Arg 156, Gly 157, Met 158, Ser 234, Tyr 238, Thr 239.

Embodiment 142. The method of any one of embodiments 140-141, wherein the inflammatory bowel disease is Crohn's disease or ulcerative colitis.

Embodiment 143. The method of embodiment 142, wherein the inflammatory bowel disease is ulcerative colitis.

Embodiment 144. The method of embodiment 142, wherein the inflammatory bowel disease is Crohn's disease.

Embodiment 145. The method of any one of embodiments 140-144, wherein administration of the TL1A binding protein is subcutaneous.

Embodiment 146. The method of any one of embodiments 140-144, wherein administration of the TL1A binding protein is intravenous.

Embodiment 147. A method of treating an inflammatory disease in an patient in need thereof, the method comprising subcutaneously or intravenously administering to the patient an effective amount of a TL1A antigen binding protein that specifically binds to a TL1A polypeptide comprising SEQ ID NO: 2493 at any one of amino acid residues Val 101, Val 102, Arg 103, Gln 104, Thr 105, Pro 106, Gln 108, His 118, Glu 120, Glu 122, Leu 123, Gly 124, Asn 136, Lys 137, Arg 156, Gly 157, Met 158, Ser 234, Tyr 238, Thr 239, wherein the TL1A antigen binding protein is an antibody Embodiment 148. The method of embodiment 147, wherein the TL1A antigen binding protein specifically binds to the TL1A sequences at amino acid residues Val 101, Val 102, Arg 103, Gln 104, Thr 105, Pro 106, Gln 108, His 118, Glu 120, Glu 122, Leu 123, Gly 124, Asn 136, Lys 137, Arg 156, Gly 157, Met 158, Ser 234, Tyr 238, Thr 239.

Embodiment 149. The method of any one of embodiments 147-148, wherein the inflammatory disease is psoriasis.

Embodiment 150. The method of any one of embodiments 147-148, wherein the inflammatory disease is psoriatic arthritis.

Embodiment 151. The method of any one of embodiments 147-148, wherein the inflammatory disease is hidradenitis suppurativa.

Embodiment 152. The method of any one of embodiments 147-151, wherein administration of the TL1A binding protein is subcutaneous.

Embodiment 153. The method of any one of embodiments 147-151, wherein administration of the TL1A binding protein is intravenous.

Embodiment 154. A method for producing the TL1A binding protein of any one of embodiments 94-127, the method comprising expressing the TL1A binding protein in a host cell and isolating the expressed TL1A binding protein.

Embodiment 155. A method for producing a TL1A binding protein that specifically binds to a TL1A polypeptide comprising SEQ ID NO: 2493 at any one of amino acid residues Val 101, Val 102, Arg 103, Gln 104, Thr 105, Pro 106, Gln 108, His 118, Glu 120, Glu 122, Leu 123, Gly 124. Asn 136, Lys 137, Arg 156, Gly 157, Met 158, Ser 234, Tyr 238, Thr 239, wherein the TL1A antigen binding protein is an antibody.

Embodiment 156. The method of embodiment 155, wherein the TL1A binding protein specifically binds to the TL1A sequences at amino acid residues Val 101, Val 102, Arg 103, Gln 104, Thr 105, Pro 106, Gln 108, His 118, Glu 120, Glu 122, Leu 123, Gly 124, Asn 136, Lys 137, Arg 156, Gly 157, Met 158, Ser 234, Tyr 238, Thr 239.

Embodiment 157. A method to obtain an antibody that specifically binds to a certain epitope portion of a TL1A sequence comprising SEQ ID NO: 2493, wherein the method comprises assessing whether an antibody binds specifically to the certain epitope portion, wherein the certain epitope portion has amino acid residues Val 101, Val 102, Arg 103, Gln 104. Thr 105, Pro 106, Gln 108, His 118, Glu 120, Glu 122, Leu 123, Gly 124, Asn 136, Lys 137, Arg 156, Gly 157, Met 158, Ser 234, Tyr 238, Thr 239 of SEQ ID NO: 2493, and isolating or selecting the an antibody that binds to the certain epitope portion.

Embodiment 158. A TL1A binding protein comprising: a) a heavy chain variable region (VH) comprising (i) a CDR1 having an amino acid sequence according to any one of CDRH1 sequences listed in TABLE 1.1 A, TABLE 1.1 B, and TABLE 1.1 C, (ii) a CDR2 having an amino acid sequence according to any one of CDRH2 sequences listed in TABLE 1.1 A, TABLE 1.1 B, and TABLE 1.1 C, and (iii) a CDR3 having an amino acid sequence according to any one of CDRH3 sequences listed in TABLE 1.1 A, TABLE 1.1 B, and TABLE 1.1 C; and b) a light chain variable region (VL) comprising (i) a CDR1 having an amino acid sequence according to any one of CDRL1 sequences listed in TABLE 1.1 A, TABLE 1.1 B, and TABLE 1.1 C, (ii) a CDR2 having an amino acid sequence according to any one of CDRL2 sequences listed in TABLE 1.1 A, TABLE 1.1 B, and TABLE 1.1 C, and (iii) a CDR3 having an amino acid sequence according to any one of CDRL3 sequences listed in TABLE 1.1 A, TABLE 1.1 B, and TABLE 1.1 C.

Embodiment 159. The TL1A binding protein of embodiment 159, wherein the VH comprises a sequence having at least 80% sequence identity to the amino acid sequence of any one of VH sequences listed in TABLE 2.1 and TABLE 2.2 and the VL comprises a sequence having at least 80% sequence identity to the amino acid sequence of any one of VL sequences listed in TABLE 2.1 and TABLE 2.2.

Embodiment 160. The TL1A binding protein of embodiment 159 or embodiment 160) comprising a Fc domain, optionally wherein the Fc domain comprises any one of the amino acid sequences listed in TABLE 3.

Embodiment 161. The TL1A binding protein of embodiment 159 or embodiment 160 comprising a Fc domain, wherein the Fc domain is an IgG1, IgG2 or IgG4 immunoglobulin Fc domain.

Embodiment 162. The TL1A binding protein of embodiment 159, wherein the Fc domain amino acid comprises amino acid modifications L234A/L235A (LALA) and/or M252Y, S254T, and T256E (YTE).

Embodiment 163. A TL1A binding protein comprising: a) a heavy chain variable region (VH) comprising (i) a CDR1 having an amino acid sequence according to any one of CDRH1 sequences listed in TABLE 1.1 A, TABLE 1.1 B, and TABLE 1.1 C, (ii) a CDR2 having an amino acid sequence according to any one of CDRH2 sequences listed in TABLE 1.1 A, TABLE 1.1 B, and TABLE 1.1 C, and (iii) a CDR3 having an amino acid sequence according to any one of CDRH3 sequences listed in TABLE 1.1 A, TABLE 1.1 B, and TABLE 1.1 C: b) a light chain variable region (VL) comprising (i) a CDR1 having an amino acid sequence according to any one of CDRL1 sequences listed in TABLE 1.1 A, TABLE 1.1 B, and TABLE 1.1 C, (ii) a CDR2 having an amino acid sequence according to any one of CDRL2 sequences listed in TABLE 1.1 A, TABLE 1.1 B, and TABLE 1.1 C, and (iii) a CDR3 having an amino acid sequence according to any one of CDRL3 sequences listed in TABLE 1.1 A, TABLE 1.1 B, and TABLE 1.1 C; and c) a modified Fc that extends half-life of the TL1A binding protein as compared to a TL1A binding protein that does not comprise the modified Fc.

Embodiment 164. The TL1A binding protein of embodiment 163, wherein the modified Fc domain amino acid comprises amino acid modifications L234A/L235A (LALA) and/or M252Y, S254T, and T256E (YTE).

EXAMPLES

The disclosure now being generally described, will be more readily understood by reference to the following examples, which are included merely for purposes of illustration of certain aspects and embodiments of the present disclosure, and is not intended to limit the disclosure.

Example 1. Determination of Antibody Affinity to TL1A

This Example describes the binding affinity of TL1A binding proteins described herein.

Figure 2A:
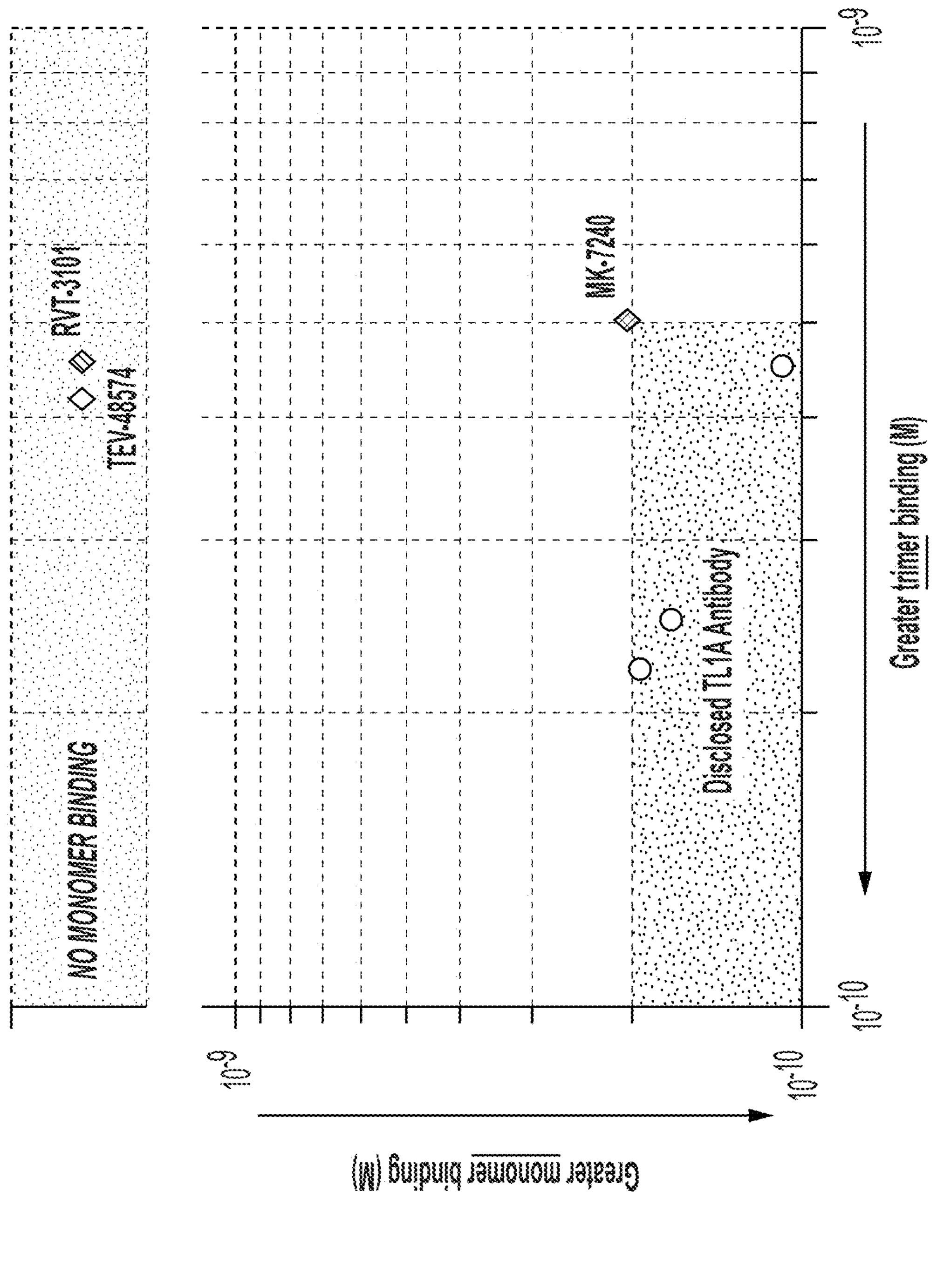
FIGS. 2A-2B depict TL1A monomer and TL1A trimer binding of various comparator antibodies compared to TL1A binding antibodies disclosed herein.
Figure 2B:
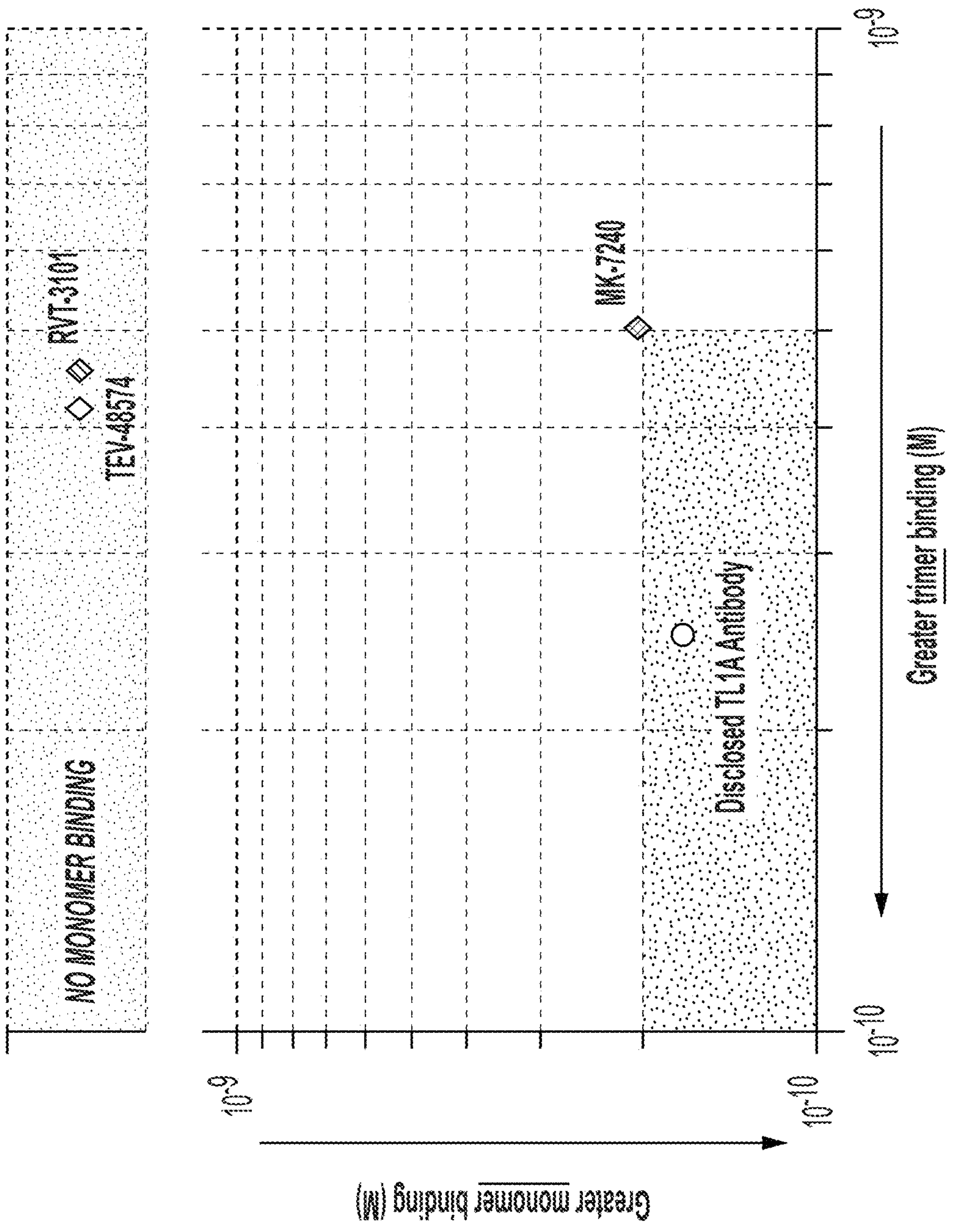
Figure 3A:
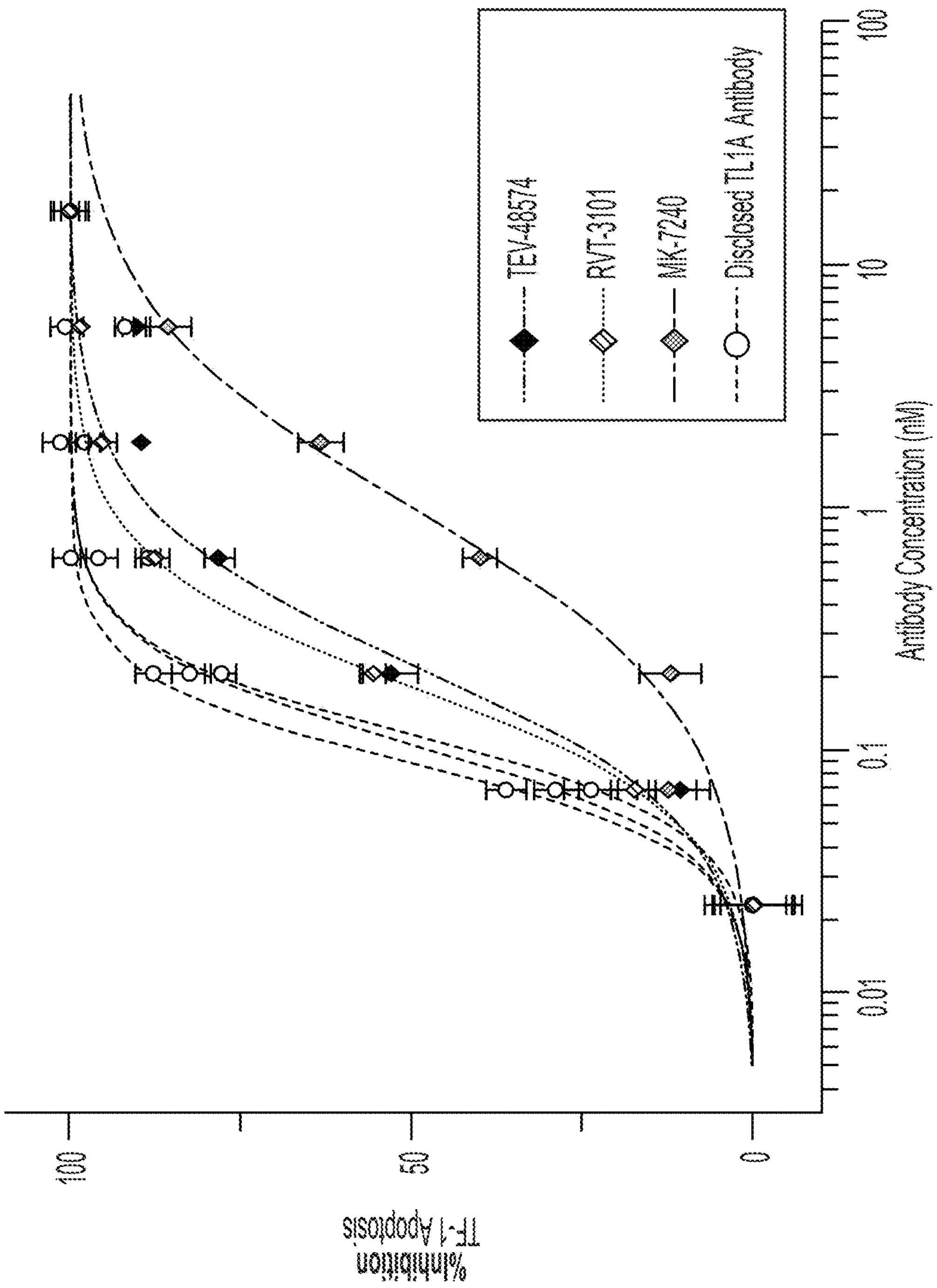
FIGS. 3A-3D depict apoptosis inhibition of various comparator antibodies compared to TL1A binding antibodies disclosed herein.
Figure 3B:
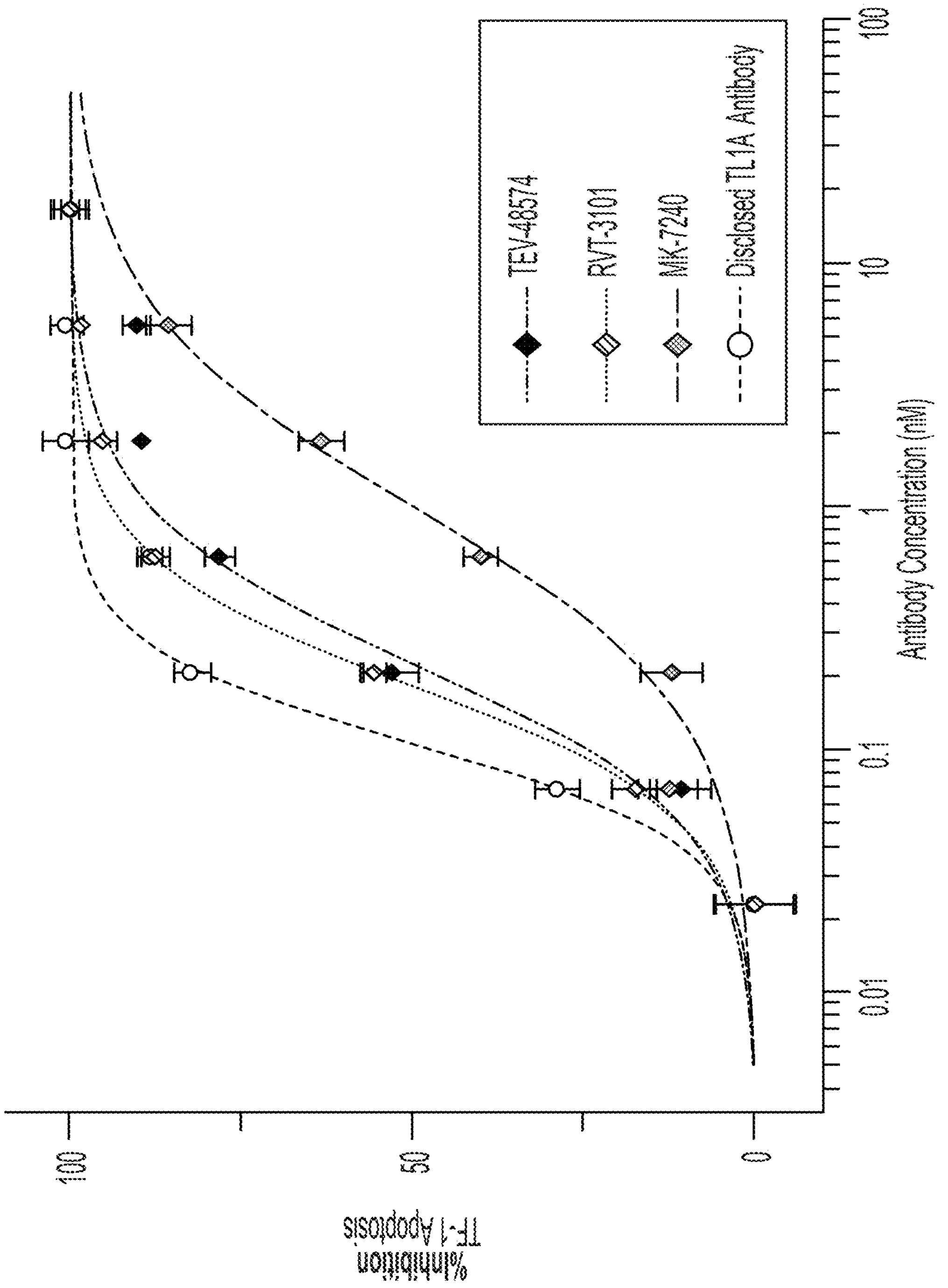
Figure 3C:
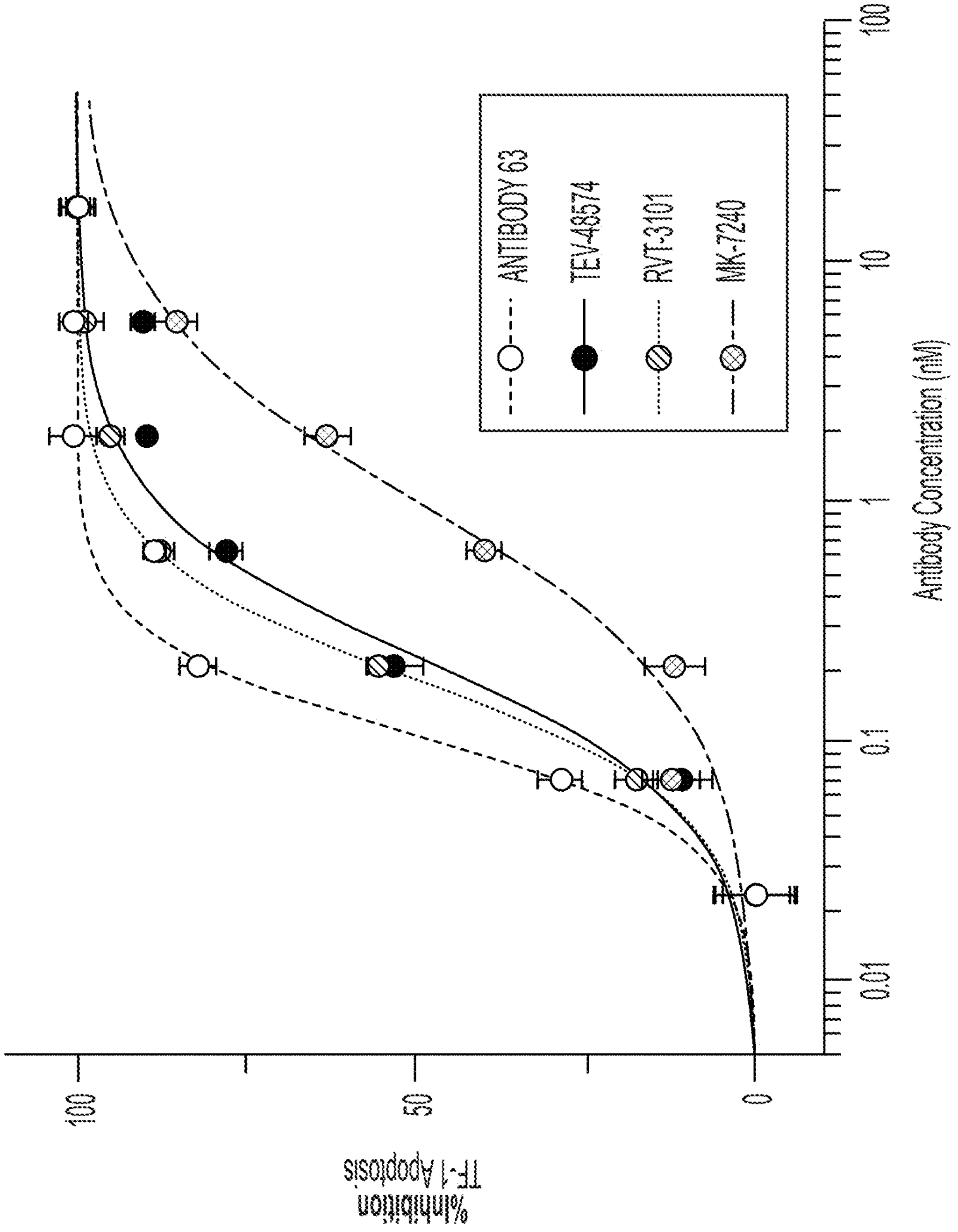
Figure 3D:
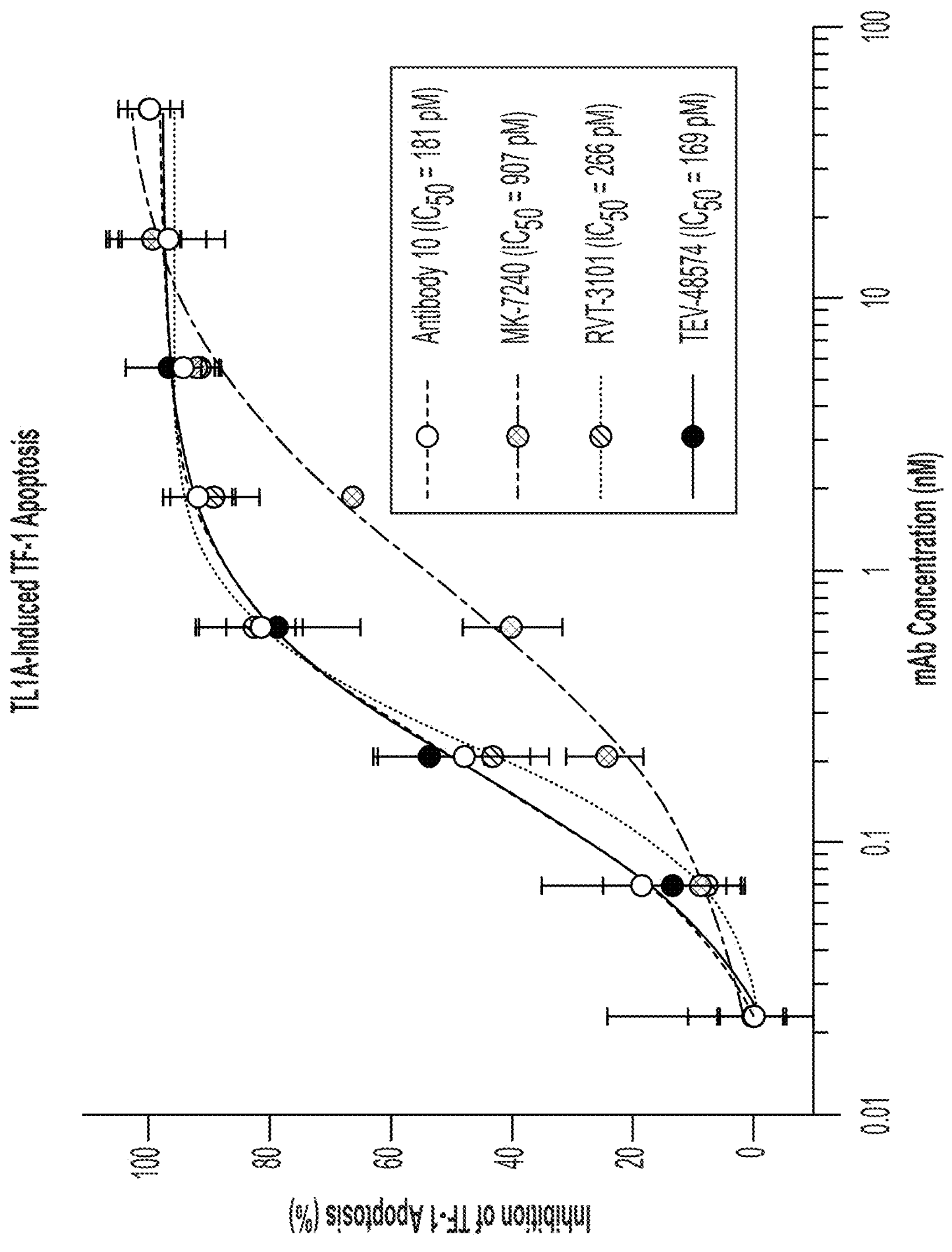

Binding affinity ($K_D$) of antibodies to human TL1A was determined through surface plasmon resonance (SPR) using a Biacore 8K. Briefly, a SPR chip functionalized with Protein G was used to capture purified antibodies at a flow rate of 10 μL/min for 60 seconds. A paired channel with only buffer was used as reference. Subsequently, concentrations of TL1A ranging from 100 nM to 1.23 nM were injected over the surface with captured purified antibody as well as the reference channel. Regeneration of the chip between different concentrations of TL1A was performed with 10 mM Glycine HCl, pH 1.5 and antibody was again captured as previously described. Association and dissociation rate constants were subsequently determined through fitting to a 1:1 Langmuir binding model using the Biacore Insight Evaluation Software from which a $K_D$ value was derived. Results are summarized in Table 4A and Table 4B. Comparator antibody 1 has an amino acid sequence substantially identical to RVT-3101 and is referred herein as RVT-3101: Comparator antibody 2 has an amino acid sequence substantially identical to MK-7240 and is referred herein as MK-7240; Comparator antibody 3 has an amino acid sequence substantially identical to TEV-48574 and is referred herein as TEV-48574. See also FIGS. 2A-2B.

TABLE 4A

| Antibody | Human TL1A $K_D$ (nM) |
|---|---|
| Comparator Antibody 1 (RVT-3101) | 0.60 |
| Comparator Antibody 2 (MK-7240) | 0.64 |
| Comparator Antibody 3 (TEV-48574) | 0.43 |
| Antibody 1 | 0.50 |
| Antibody 2 | 0.43 |
| Antibody 3 | 0.01 |
| Antibody 4 | 0.47 |
| Antibody 5 | 0.46 |

TABLE 4A-continued

| Antibody | Human TL1A $K_D$ (nM) |
|---|---|
| Antibody 6 | 0.24 |
| Antibody 7 | 0.33 |
| Antibody 8 | 0.32 |
| Antibody 9 | 0.38 |
| Antibody 10 | 0.28 |
| Antibody 11 | 0.770 |
| Antibody 12 | 0.255 |
| Antibody 13 | 0.596 |
| Antibody 14 | 0.582 |
| Antibody 15 | 0.408 |
| Antibody 16 | 0.464 |
| Antibody 17 | 0.573 |
| Antibody 18 | 0.709 |
| Antibody 19 | 0.451 |
| Antibody 20 | 0.398 |
| Antibody 21 | 0.545 |
| Antibody 22 | 0.349 |
| Antibody 23 | 0.575 |
| Antibody 24 | 0.562 |
| Antibody 25 | 0.373 |
| Antibody 26 | 0.351 |
| Antibody 27 | 0.522 |
| Antibody 28 | 0.527 |
| Antibody 29 | 0.397 |
| Antibody 30 | 0.473 |
| Antibody 31 | 0.694 |
| Antibody 32 | 0.582 |
| Antibody 33 | 0.655 |
| Antibody 34 | 0.540 |
| Antibody 35 | 0.171 |
| Antibody 36 | 0.382 |
| Antibody 37 | 0.475 |
| Antibody 38 | 0.656 |
| Antibody 39 | 0.279 |
| Antibody 40 | 0.543 |
| Antibody 41 | 0.782 |
| Antibody 42 | 0.397 |
| Antibody 43 | 0.365 |
| Antibody 44 | 0.640 |

TABLE 4A-continued

| Antibody | Human TL1A $K_D$ (nM) |
|---|---|
| Antibody 45 | 0.707 |
| Antibody 46 | 0.591 |
| Antibody 47 | 0.451 |
| Antibody 48 | 0.329 |
| Antibody 49 | 0.247 |
| Antibody 50 | 0.437 |
| Antibody 51 | 0.646 |
| Antibody 52 | 0.347 |
| Antibody 53 | 0.542 |
| Antibody 54 | 0.686 |
| Antibody 55 | 0.588 |
| Antibody 56 | 0.518 |
| Antibody 57 | 0.564 |
| Antibody 58 | 0.713 |
| Antibody 59 | 0.755 |
| Antibody 60 | 0.971 |
| Antibody 61 | 0.664 |
| Antibody 62 | 0.510 |
| Antibody 63 | 0.249 |
| Antibody 64 | 0.449 |
| Antibody 65 | 0.505 |
| Antibody 66 | 0.597 |
| Antibody 67 | 0.648 |
| Antibody 68 | 0.374 |
| Antibody 69 | 0.247 |
| Antibody 70 | 0.286 |
| Antibody 71 | 0.312 |
| Antibody 72 | 0.691 |
| Antibody 73 | 0.750 |
| Antibody 74 | 0.868 |
| Antibody 75 | 0.611 |
| Antibody 76 | 0.871 |
| Antibody 77 | 0.883 |
| Antibody 78 | 0.712 |
| Antibody 79 | 0.929 |
| Antibody 80 | 0.267 |
| Antibody 81 | 0.332 |
| Antibody 82 | 0.631 |
| Antibody 83 | 0.859 |

TABLE 4A-continued

| Antibody | Human TL1A $K_D$ (nM) |
|---|---|
| Antibody 84 | 0.701 |
| Antibody 85 | 0.275 |
| Antibody 86 | 0.221 |
| Antibody 87 | 1.07 |
| Antibody 88 | 1.08 |
| Antibody 89 | 0.628 |
| Antibody 90 | 0.609 |
| Antibody 91 | 0.525 |
| Antibody 92 | 0.428 |
| Antibody 93 | 0.685 |
| Antibody 94 | 0.823 |
| Antibody 95 | 0.607 |
| Antibody 96 | 0.858 |
| Antibody 97 | 0.784 |
| Antibody 98 | 0.431 |
| Antibody 99 | 0.614 |
| Antibody 100 | 0.455 |
| Antibody 101 | 0.872 |
| Antibody 102 | 0.835 |
| Antibody 103 | 0.760 |
| Antibody 104 | 0.724 |
| Antibody 105 | 0.579 |
| Antibody 106 | 0.983 |
| Antibody 107 | 0.527 |
| Antibody 108 | 0.724 |
| Antibody 109 | 0.493 |
| Antibody 110 | 0.741 |
| Antibody 111 | 2.36 |
| Antibody 112 | 0.531 |
| Antibody 113 | 0.983 |
| Antibody 114 | 0.758 |
| Antibody 115 | 0.294 |
| Antibody 116 | 1.16 |
| Antibody 117 | 1.00 |
| Antibody 118 | 0.345 |
| Antibody 119 | 0.450 |

TABLE 4B

| Antibody | TL1A | FasL | TRAIL | LIGHT |
|---|---|---|---|---|
| Antibody 10 | 0.15 nM | NB | NB | NB |
| MK-7240 | 0.71 nM | NB | NB | NB |
| RVT-3101 | 0.57 nM | NB | NB | NB |
| TEV-48574 | 0.44 nM | NB | NB | NB |

NB = no binding

Example 2. Antibody Binding to Membrane TL1A

This Example describes antibody binding of TL1A binding proteins described herein.

Antibody binding to membrane TL1A was determined using FACS and a TL1A overexpression cell line. Briefly, HEK293 previously transduced to stably express human TL1A were cultured and harvested. The cells were stained with either 100 nM or 10 nM of purified antibody at 4° C., for 1 hour. Cells were subsequently stained with a FITC-conjugated goat anti-human IgG secondary antibody at a 1:500 dilution. Cells were incubated 4° C., for 30 minutes, protected from light. Cells were then washed and the MFI of cells in each well was recorded by FACS. The data is seen in FIG. 1 (MFI, mean fluorescence intensity).

Example 3. Inhibition of TL1A Binding to DR3 and DcR3

This Example describes the functional blockade of TL1A binding proteins described herein.

Recombinant TL1A binding to either recombinant DR3 or DcR3 by ELISA was used to evaluate the functional blockade of antibodies against these two binding interactions. Briefly, an ELISA plate was coated with either 4 μg/mL recombinant hDR3 or 1 μg/mL recombinant hDcR3 at 4° C., overnight. This was followed by incubation with 1% BSA to block nonspecific binding, at room temperature for 2 hours. Recombinant hTL1A biotinylated at an N-terminal Avi-Tag™ was premixed with purified antibody, with the final concentration of TL1A being 1 μg/mL in the DR3 assay or 3 ng/mL in the DcR3 assay and antibody ranging from 200 nM to 0.006 nM. This was then incubated on the plate at room temperature for 1 hour. TL1A was detected using a streptavidin-peroxidase polymer and the plate developed using TMB substrate. Between all steps, ELISA plates were thoroughly washed with washing buffer. The TMB reaction was stopped with HCl and absorbances at 450 nm were read on a microplate reader. $IC_{50}$ values were determined as the concentration of antibody required to inhibit 50% of the maximum absorbance of TL1A detected with no antibody.

Example 4. Inhibition of TL1A-Induced Apoptosis in TF-1 Cells

This Example describes the inhibition of TL1A-induced apoptosis by TL1A binding proteins described herein.

Inhibition of apoptosis in TF-1 cells was used to evaluate the functional activity of antibodies to block TL1A-induced biological activity. Briefly, TF-1 cells were collected and seeded at 20,000 cells per well. Concurrently, human TL1A, purified antibody, and cycloheximide were premixed before adding to the wells. The final concentration of human TL1A was 25 ng/ml; the final concentration of purified antibody ranged from 50 nM to 0.023 nM, and the final concentration of cycloheximide was 1 μg/mL. Cells were incubated at 37° C. for 6 hours before using Caspase-Glo 3/7 reagent to determine degree of apoptosis. Luminescence was read on a microplate reader. $IC_{50}$ values were determined as the concentrations of antibody required to inhibit 50% of the maximum apoptosis detected with incubation of 25 ng/ml of TL1A alone. Results are summarized in Table 5 and Table 6. See also FIGS. 3A-3D.

TABLE 5

| Antibody | TF-1 Apoptosis Inhibition $IC_{50}$ (nM) |
|---|---|
| Comparator Antibody 1 (RVT-3101) | 0.29 |
| Comparator Antibody 2 (MK-7240) | 1.23 |
| Comparator Antibody 3 (TEV-48574) | 0.28 |
| Antibody 1 | 0.36 |
| Antibody 2 | 0.26 |
| Antibody 3 | 0.31 |
| Antibody 4 | 0.37 |
| Antibody 5 | 0.32 |
| Antibody 6 | 0.16 |
| Antibody 7 | 0.22 |
| Antibody 8 | 0.21 |
| Antibody 9 | 0.21 |
| Antibody 10 | 0.22 |

TABLE 6

| Antibody | TF-1 Apoptosis Inhibition $IC_{50}$ (nM) |
|---|---|
| Comparator Antibody 1 (RVT-3101) | 0.188 |
| Comparator Antibody 2 (MK-7240) | 0.857 |
| Comparator Antibody 3 (TEV-48574) | 0.204 |
| Antibody 11 | 0.151 |
| Antibody 12 | 0.153 |
| Antibody 13 | 0.142 |
| Antibody 14 | 0.125 |
| Antibody 15 | 0.176 |
| Antibody 16 | 0.122 |
| Antibody 17 | 0.114 |
| Antibody 18 | 0.175 |
| Antibody 19 | 0.140 |
| Antibody 20 | 0.098 |
| Antibody 21 | 0.112 |

TABLE 6-continued

| Antibody | TF-1 Apoptosis Inhibition $IC_{50}$ (nM) |
|---|---|
| Antibody 22 | 0.128 |
| Antibody 23 | 0.110 |
| Antibody 24 | 0.152 |
| Antibody 25 | 0.105 |
| Antibody 26 | 0.167 |
| Antibody 27 | 0.150 |
| Antibody 28 | 0.203 |
| Antibody 29 | 0.107 |
| Antibody 30 | 0.193 |
| Antibody 31 | 0.253 |
| Antibody 32 | 0.106 |
| Antibody 33 | 0.111 |
| Antibody 34 | 0.137 |
| Antibody 35 | 0.207 |
| Antibody 36 | 0.123 |
| Antibody 37 | 0.178 |
| Antibody 38 | 0.159 |
| Antibody 39 | 0.103 |
| Antibody 40 | 0.105 |
| Antibody 41 | 0.201 |
| Antibody 42 | 0.127 |
| Antibody 43 | 0.084 |
| Antibody 44 | 0.217 |
| Antibody 45 | 0.199 |
| Antibody 46 | 0.121 |
| Antibody 47 | 0.099 |
| Antibody 48 | 0.083 |
| Antibody 49 | 0.076 |
| Antibody 50 | 0.090 |
| Antibody 51 | 0.079 |
| Antibody 52 | 0.078 |
| Antibody 53 | 0.172 |
| Antibody 54 | 0.175 |
| Antibody 55 | 0.109 |
| Antibody 56 | 0.137 |
| Antibody 57 | 0.138 |
| Antibody 58 | 0.205 |
| Antibody 59 | 0.145 |

TABLE 6-continued

| Antibody | TF-1 Apoptosis Inhibition $IC_{50}$ (nM) |
|---|---|
| Antibody 60 | 0.183 |
| Antibody 61 | 0.162 |
| Antibody 62 | 0.131 |
| Antibody 63 | 0.100 |
| Antibody 64 | 0.137 |
| Antibody 65 | 0.133 |
| Antibody 66 | 0.293 |
| Antibody 67 | 0.234 |
| Antibody 68 | 0.113 |
| Antibody 69 | 0.111 |
| Antibody 70 | 0.097 |
| Antibody 71 | 0.091 |
| Antibody 72 | 0.168 |
| Antibody 73 | 0.147 |
| Antibody 74 | 0.183 |
| Antibody 75 | 0.143 |
| Antibody 76 | 0.221 |
| Antibody 77 | 0.224 |
| Antibody 78 | 0.230 |
| Antibody 79 | 0.193 |
| Antibody 80 | 0.107 |
| Antibody 81 | 0.107 |
| Antibody 82 | 0.098 |
| Antibody 83 | 0.268 |
| Antibody 84 | 0.210 |
| Antibody 85 | 0.143 |
| Antibody 86 | 0.120 |
| Antibody 87 | 0.136 |
| Antibody 88 | 0.115 |
| Antibody 89 | 0.134 |
| Antibody 90 | 0.189 |
| Antibody 91 | 0.093 |
| Antibody 92 | 0.092 |
| Antibody 93 | 0.126 |
| Antibody 94 | 0.147 |
| Antibody 95 | 0.190 |
| Antibody 96 | 0.175 |
| Antibody 97 | 0.226 |
| Antibody 98 | 0.105 |

TABLE 6-continued

| Antibody | TF-1 Apoptosis Inhibition $IC_{50}$ (nM) |
|---|---|
| Antibody 99 | 0.141 |
| Antibody 100 | 0.151 |
| Antibody 101 | 0.266 |
| Antibody 102 | 0.194 |
| Antibody 103 | 0.189 |
| Antibody 104 | 0.411 |
| Antibody 105 | 0.225 |
| Antibody 106 | 0.219 |
| Antibody 107 | 0.107 |
| Antibody 108 | 0.170 |
| Antibody 109 | 0.130 |
| Antibody 110 | 0.183 |
| Antibody 111 | 1.610 |
| Antibody 112 | 0.501 |
| Antibody 113 | 0.276 |
| Antibody 114 | 0.133 |
| Antibody 115 | 0.522 |
| Antibody 116 | 0.376 |
| Antibody 117 | 0.385 |
| Antibody 118 | 0.608 |
| Antibody 119 | 0.604 |

Example 5. Inhibition of IFNγ secretion

A primary human whole blood-based assay measuring IFNγ secretion was used to assess functional blockade of exogenously added TL1A. For measuring IFNγ, whole blood was added to plates precoated with Human IgG at 1 mg/mL followed by 0.04 mg/mL mouse anti-human IgG in the presence of 2.5 ng/ml IL-12 and 0.25 ng/ml IL-18. Antibodies were added directly to the wells containing whole blood and cytokines at the indicated concentrations and incubated for 24 hr at 37° C. After 24 hr IFNγ levels are determined by ELISA.

Figure 5A:
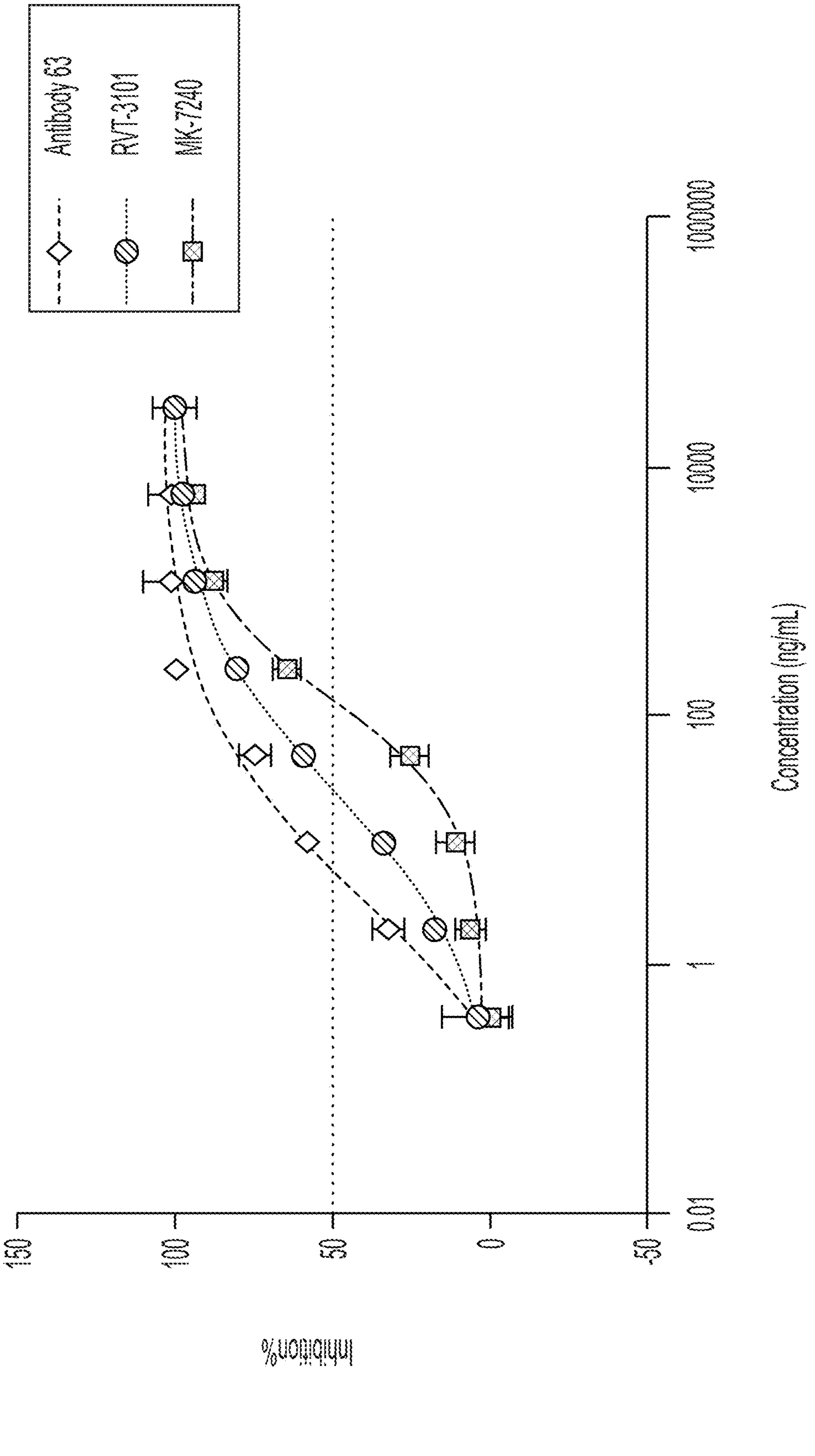
FIGS. 5A and 5B depict inhibition of TL1A-induced apoptosis in response to various comparator antibodies and TL1A binding antibodies described herein.
Figure 5B:
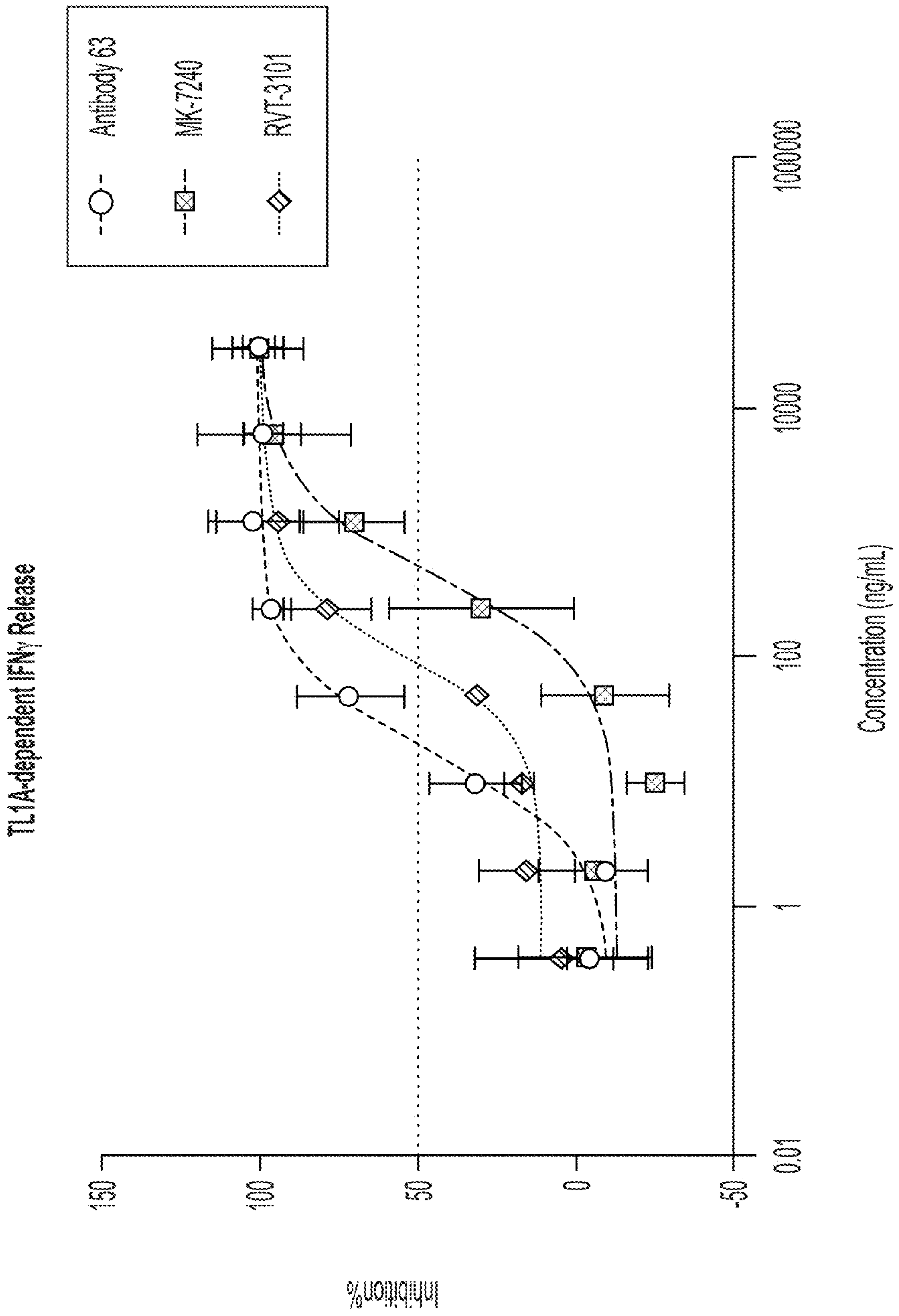

FIGS. 5A and 5B show that the TL1A antibodies described herein inhibit TL1A-induced apoptosis and IFNγ secretion with comparable or lower IC50 values vs, comparator antibodies.

Example 6. Inhibition of Human IL-23 and TL1A-induced IL-17 Response in Human PBMCs Inhibition of IL-17 response induced by human IL-23 and TL1A was used to evaluate activity of anti-TL1A antibodies in human peripheral blood mononuclear cells (PBMCs). Briefly, frozen human PBMCs from healthy donors (N=6) were seeded into 96-well plate at $5\times10^5$ cells/well. Cells were then treated with 0-500 nM of antibody, 300 ng/ml of human IL-23 and 300 ng/ml of human TL1A for 72 hours at 37° C., in a 5% $CO_2$ incubator. After 72 hours, supernatants were harvested, and IL-17 measured by ELISA. Anti-TL1A antibody showed a dose-dependent inhibition of IL-17 production.

Example 7. Activity and Half-life of TL1A Antibodies

This Example describes determination of half-life of TL1A antibodies in vitro and in vivo (i.e., in non-human primates (NHP)).

Half-life extension was measured via pharmacokinetic analysis in both Tg276 transgenic mice (hemizygous for human FcRn) and non-human primates given a single bolus of the TL1A antibody by intravenous and/or subcutaneous administration.

Figure 4A:
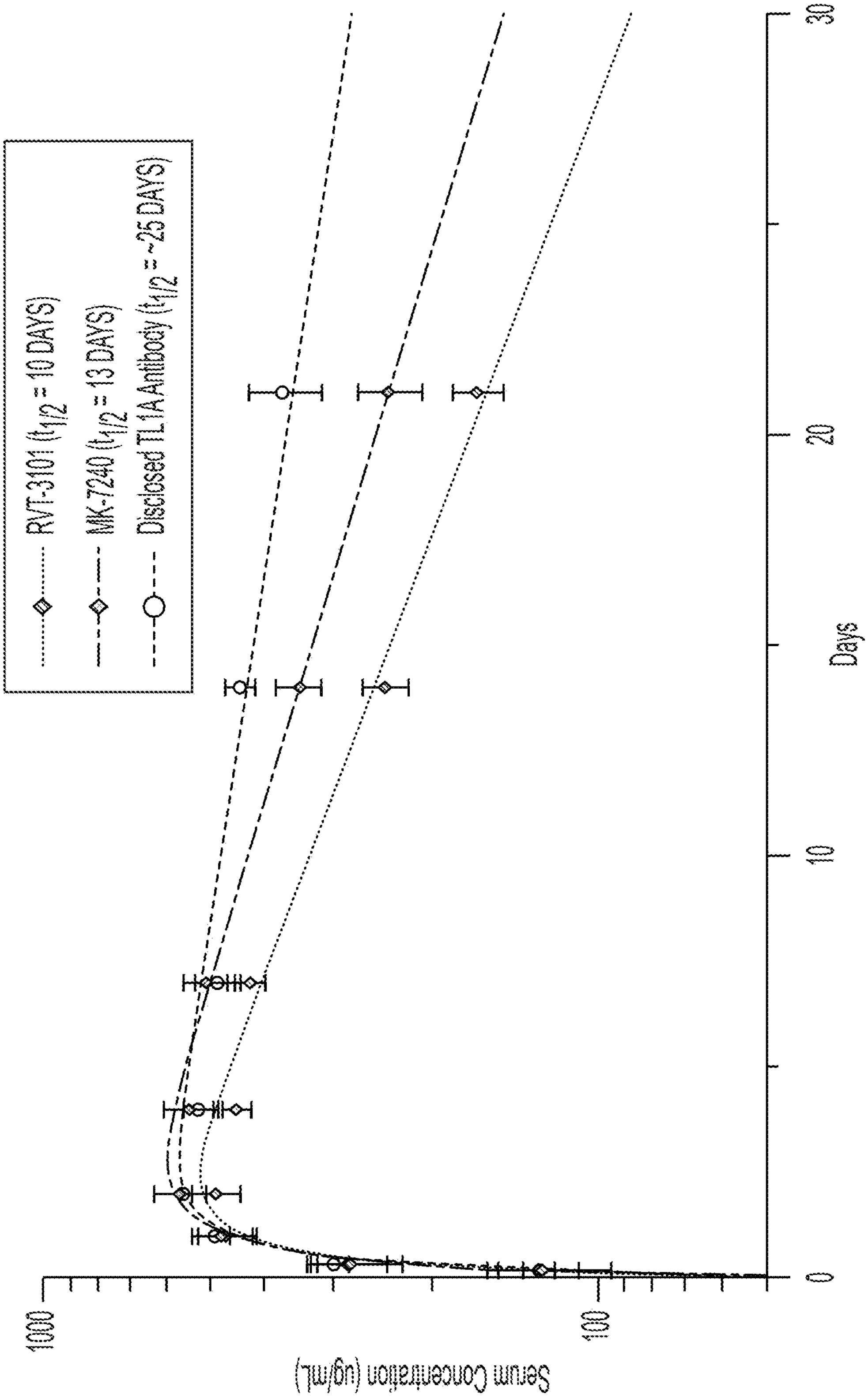
FIGS. 4A-4E depict half-life of TL1A binding antibodies disclosed herein in non-human primates.
Figure 4B:
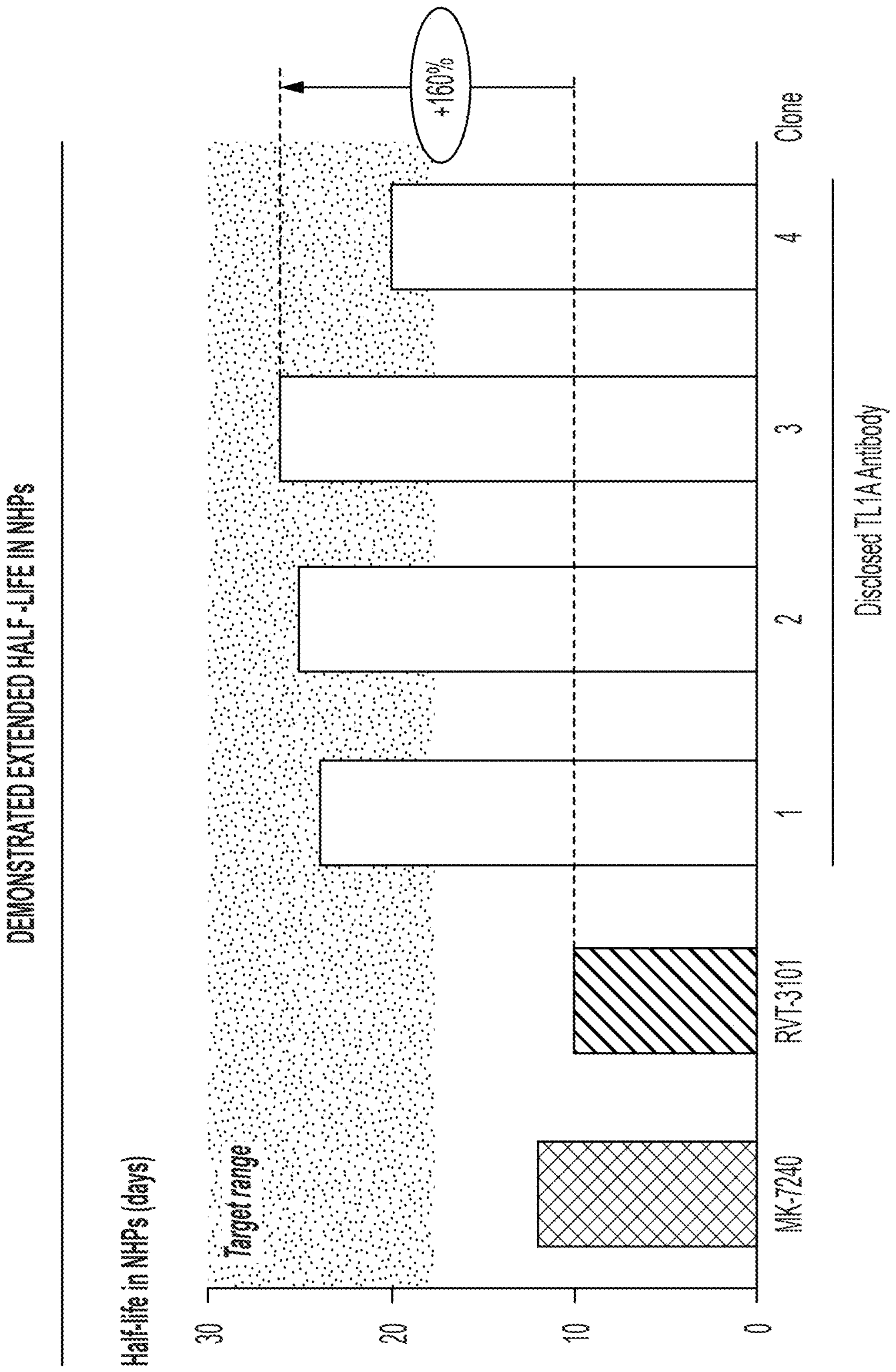

The data is seen in FIGS. 4A-4B. The half-life of an anti-TL1A antibody disclosed herein was determined compared to Comparator Antibody (Ab) 1 (RVT-3101) and Comparator Antibody 2 (MK-7240). The TL1A antibody disclosed herein exhibited a half-life of ~25 days versus 10-13 days for competing TL1A antibodies. Comparator Antibody 1 and Comparator Antibody 2 exhibited half-lives in humans of 20 and 19 days, respectively.

Figure 4C:
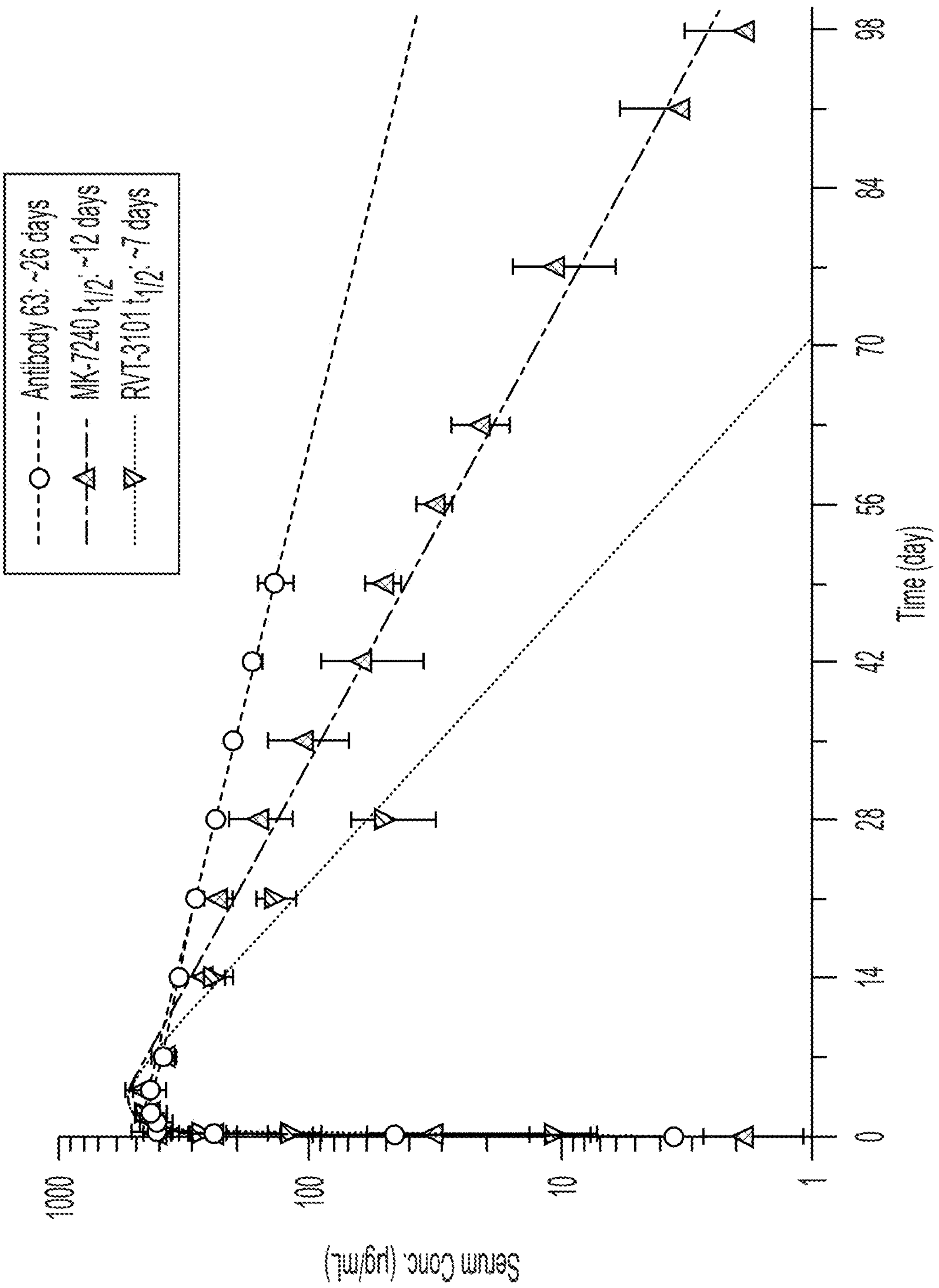
Figure 4D:
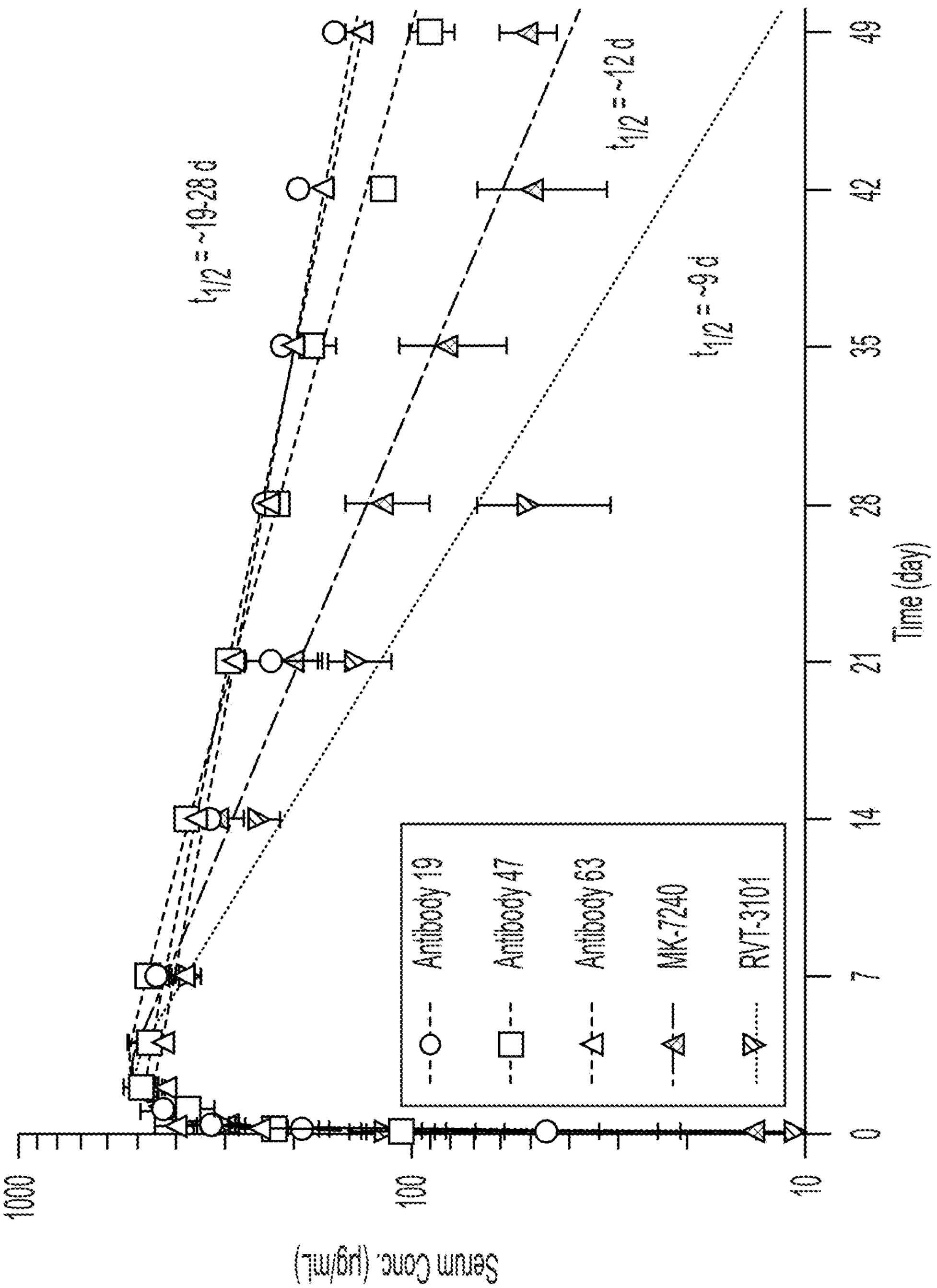

The half-life of Antibody 63 described herein is significantly extended in Tg276 mice (13-17 days) compared to RVT-3101 (~3 days) and MK-7240 (~10 days). In cynomolgus monkeys, the half-life of the TL1A antibodies described herein is at least 18 days (~19-28 days, See FIG. 4D) including about 26-28 days for Antibody 63 (See FIG. 4C), compared to an observed half-life of about 7-12 days for RVT-3101 and MK-7240. See FIGS. 4C-4D and Table 7.

TABLE 7

| Half-Life | |
|---|---|
| | $t_{1/2}$ (days) |
| Antibody 19 | 25.2 |
| Antibody 47 | 19.0 |
| Antibody 63 | 27.9 |
| MK-7240 | 12.2 |
| RVT-3101 | 8.5 |

Figure 4E:
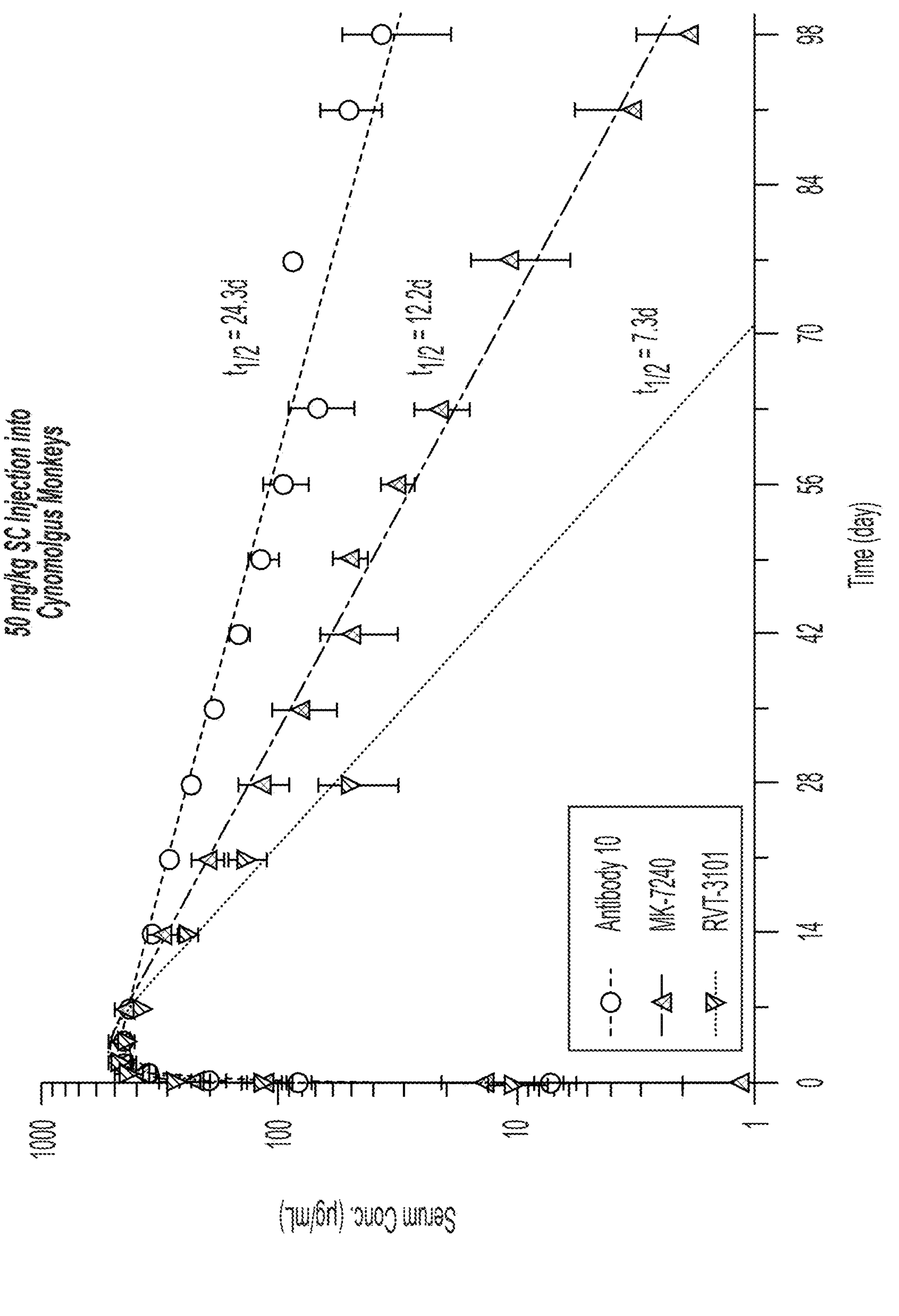
Figure 4F:
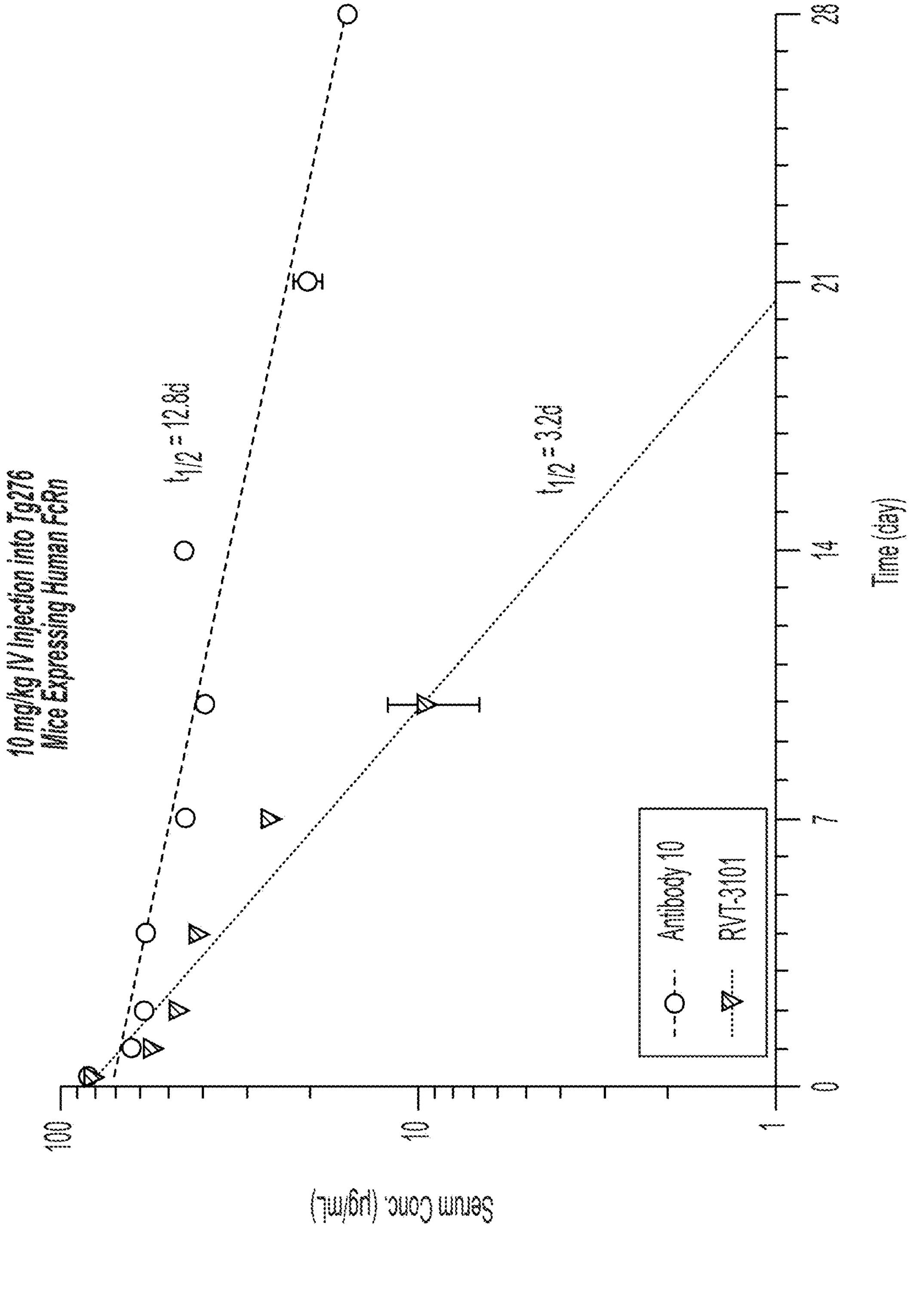
FIG. 4F depicts half-life of TL1A binding antibodies disclosed herein in Tg276 mice expressing human FcRn.

The half-life of Antibody 10 (~13 days) is significantly extended in Tg276 mice compared to RVT-3101 (~3 days) and MK-7240 (~10 days) (See FIG. 4F). In cynomolgus monkeys, the half-life of the TL1A antibodies described herein is at least 18 days, including ~24 days for Antibody 10, compared to an observed half-life of 7-12 days for RVT-3101 and MK-7240. See FIG. 4E.

Example 8. TL1A Antibody Formulations

This Example describes formulations of TL1A antibodies disclosed herein.

Figure 6A:
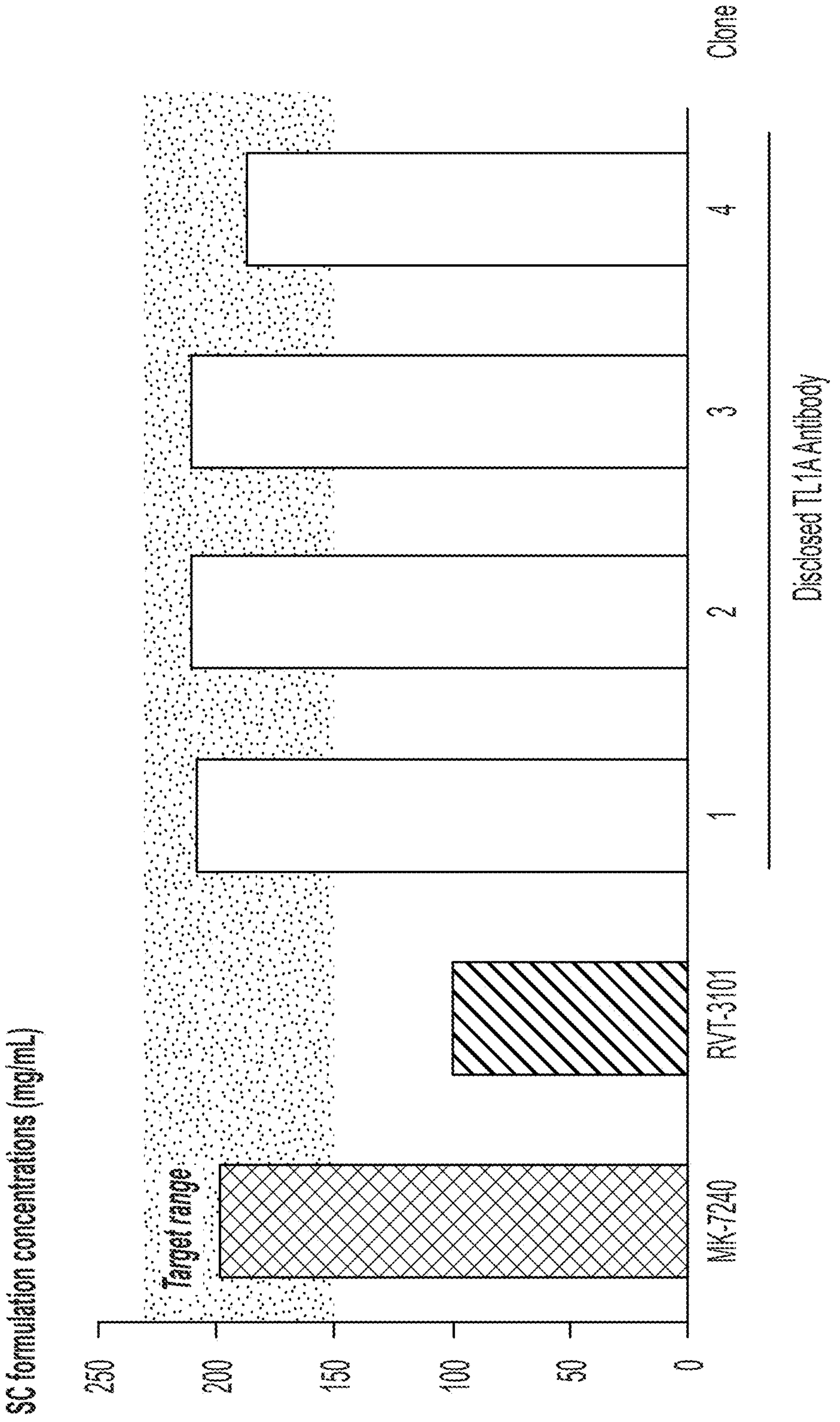
FIGS. 6A-6C depict formulation data of TL1A binding antibodies described herein compared to various comparator antibodies.
Figure 6B:
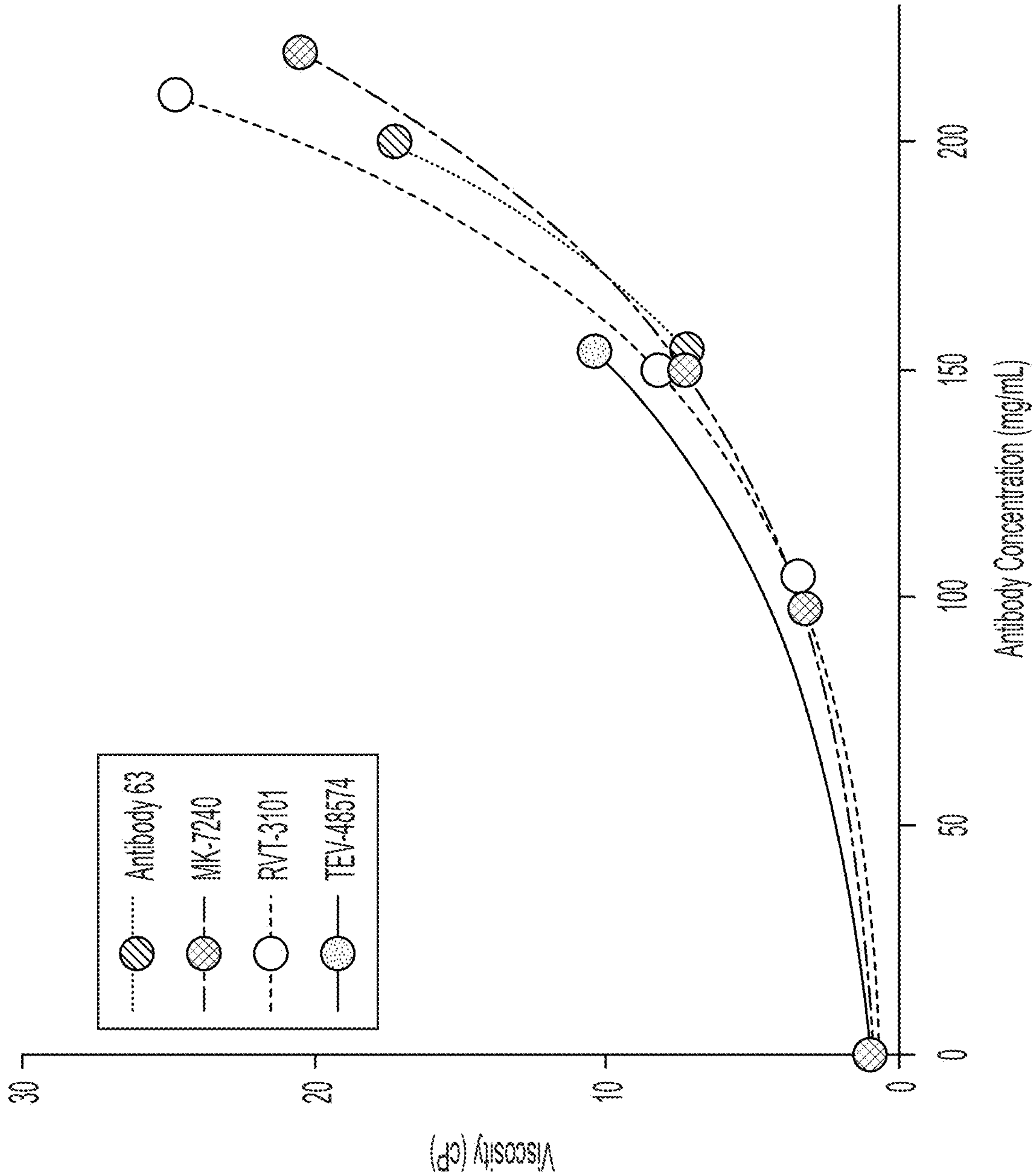
Figure 6C:
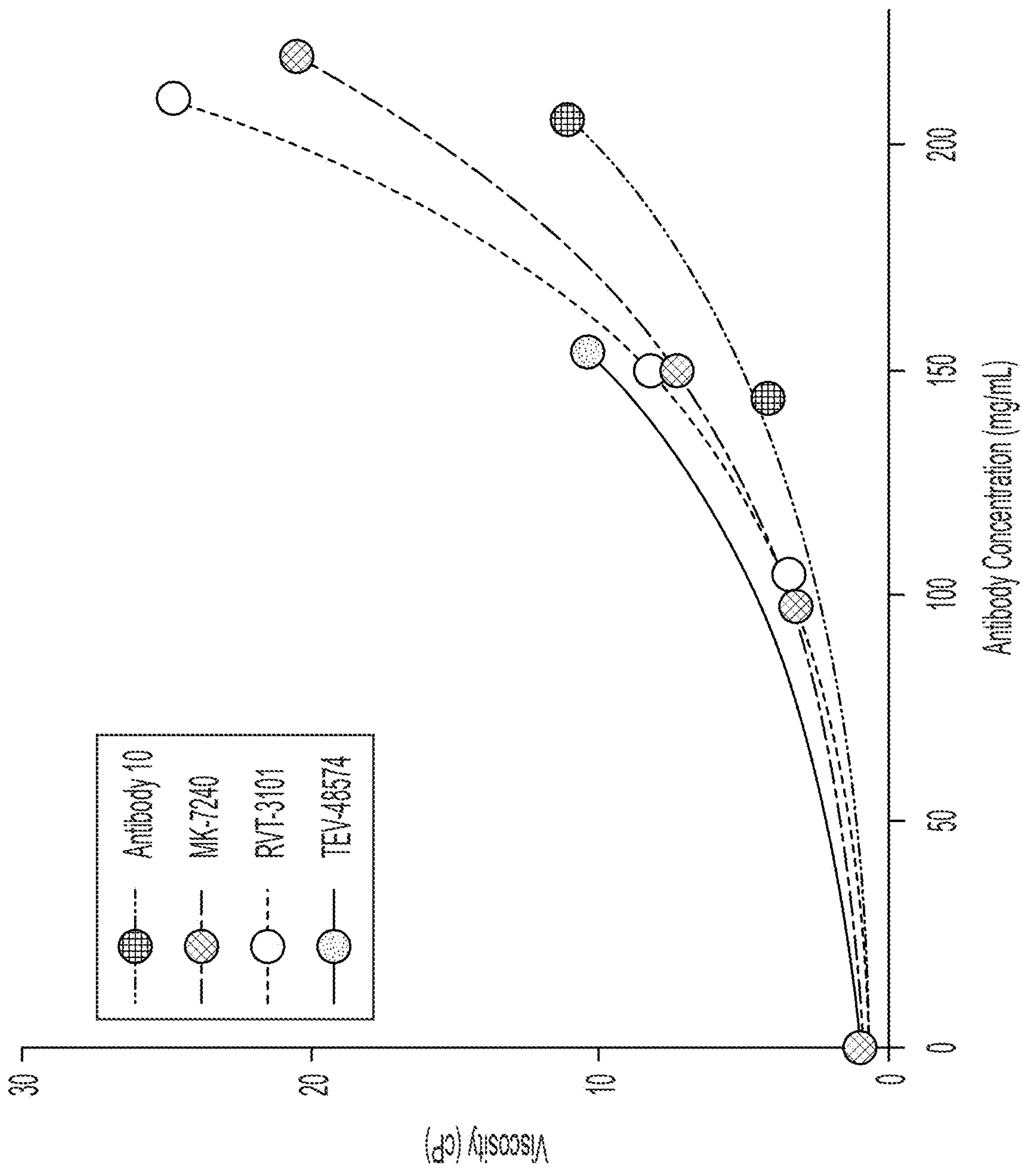
Figure 7A:
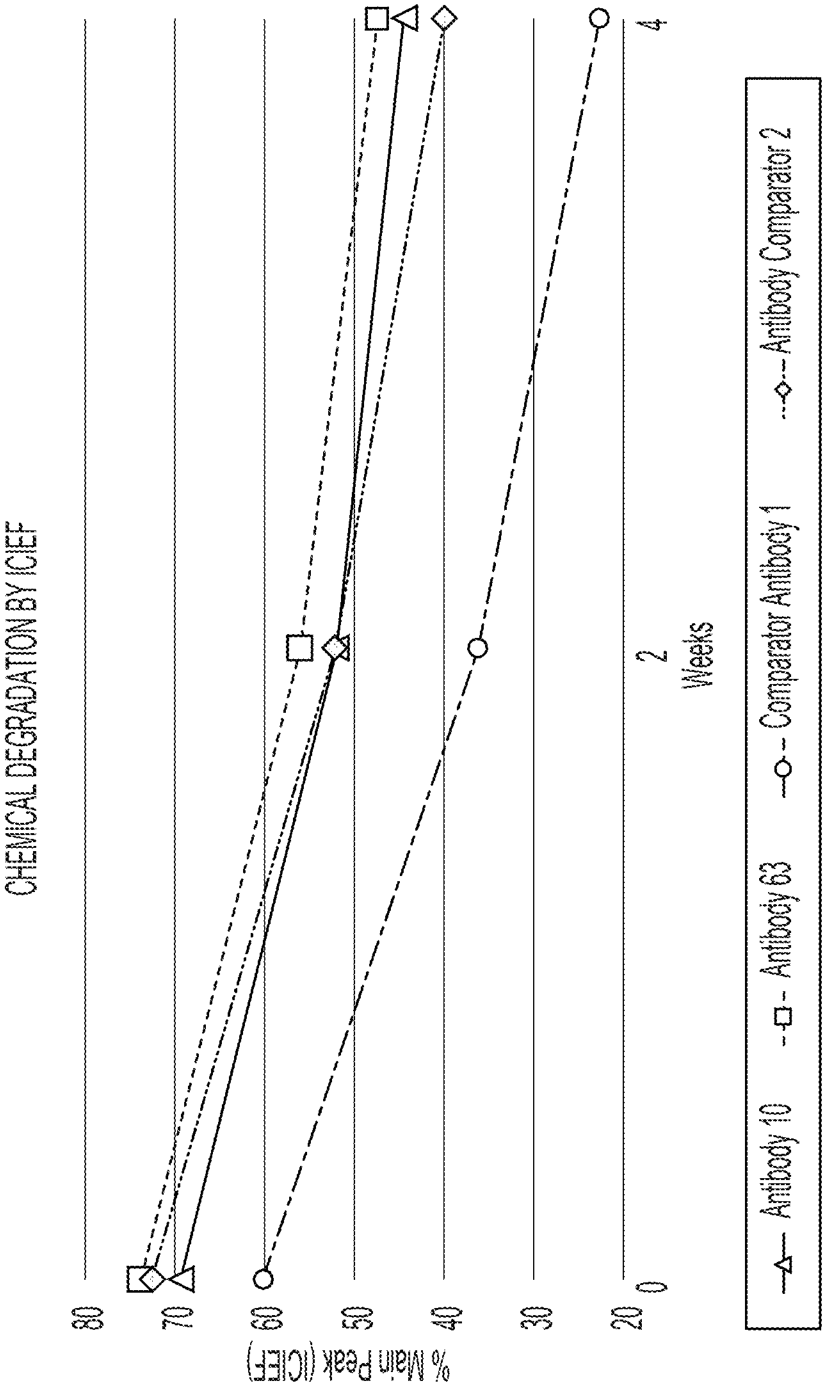
Figure 7B:
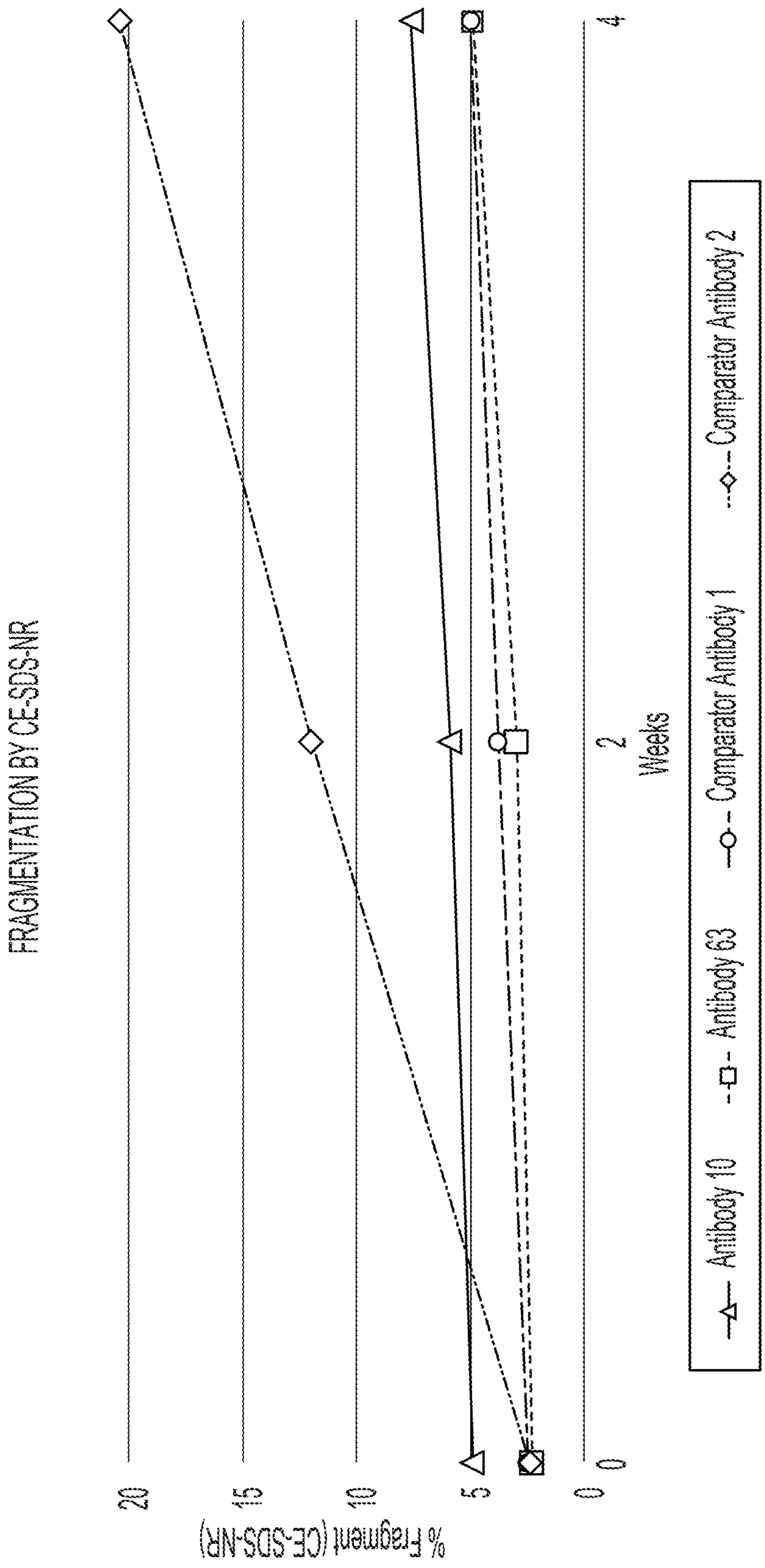
Figure 7D:
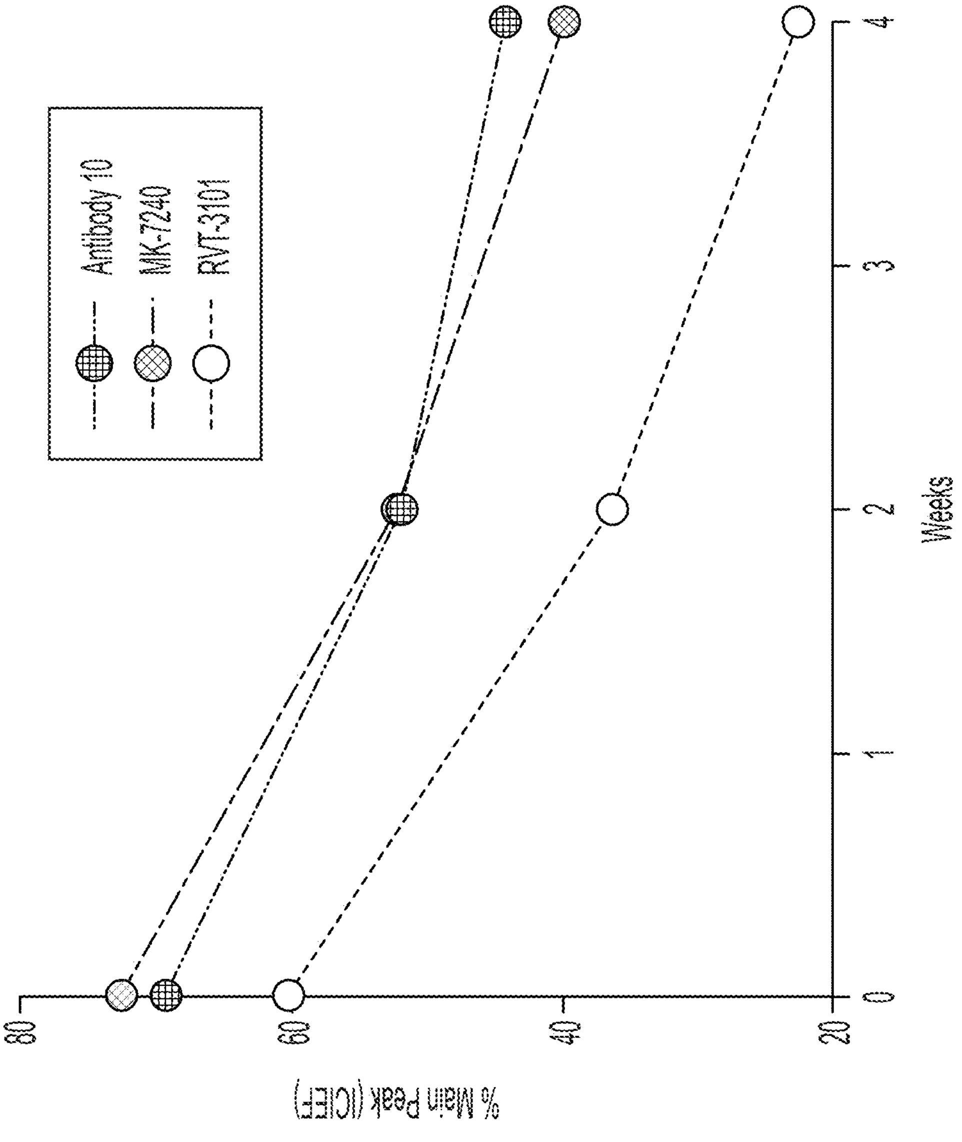
Figure 7E:
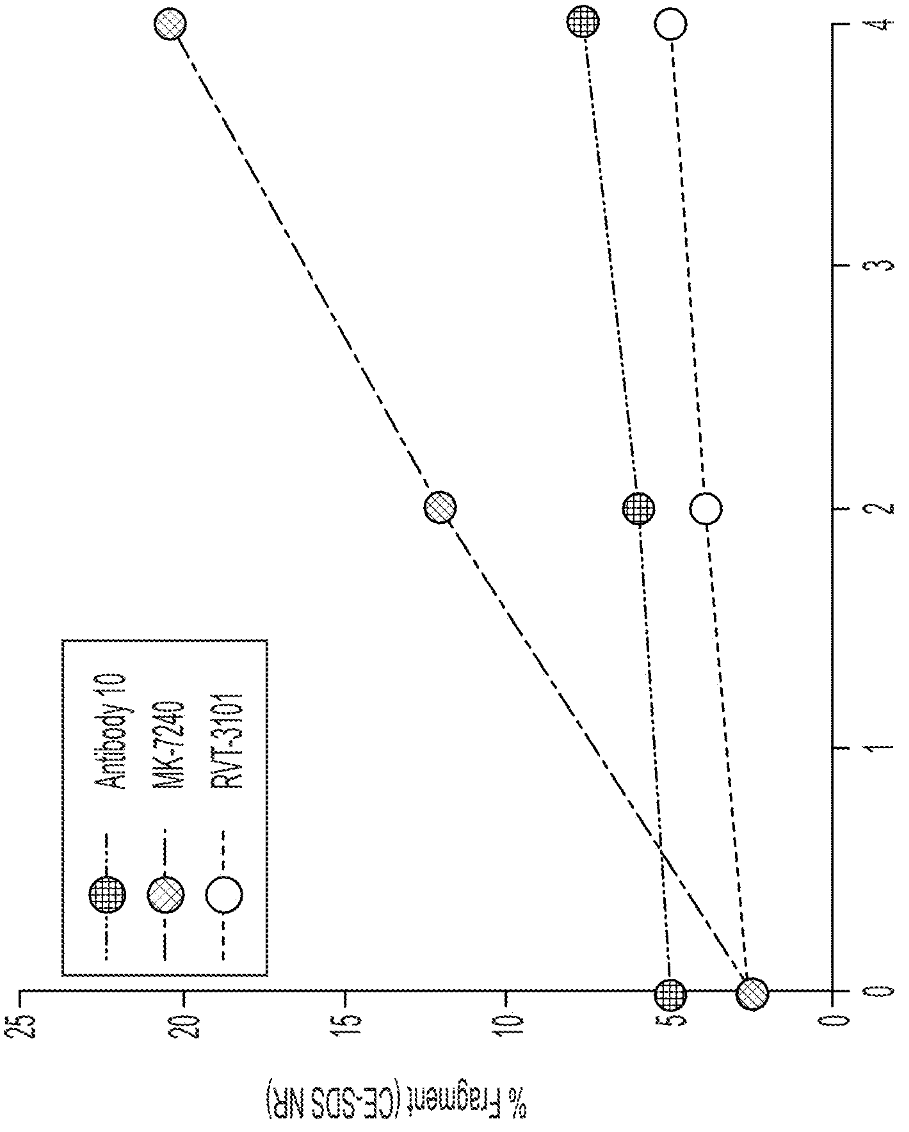

Briefly, TL1A antibodies disclosed herein were formulated as high concentration formulations. Subcutaneous (SC) formulation concentrations in mg/mL of disclosed TL1A antibodies were measured against Comparator Antibody 1 (RVT-3101) and Comparator Antibody 2 (MK-7240). As seen in FIGS. 6A-6C and Table 8, TL1A antibodies disclosed herein can be formulated to high concentrations (≥200 mg/mL). In addition, the viscosity of the TL1A antibodies disclosed herein is comparable or lower than the viscosity of the comparator antibodies (See FIGS. 6B-6C and Table 8)

TABLE 8

| Parameter | Antibody 10 | Antibody 63 | RVT-3101 | MK-7240 | TEV-48574 |
|---|---|---|---|---|---|
| Route of Admin | SC autoinjector | SC autoinjector | SC autoinjector | IV load/ SC autoinjector | SC infusion (high volume) |
| Dose Frequency | Q12W+ | Q12W+ | Q4W | Q4W | Q2-4W |
| Concentration | ≥200 mg/mL | ≥200 mg/mL | 100 mg/mL | 60-200 mg/mL | 100 mg/mL |
| Bioavailability | TBD | TBD | 45% | >80% | ND |
| pH range | 5.5-6.5 | 5.5-6.5 | ND | ND | ND |
| Viscosity (150 g/L) | 7.1 cP | 10.5 cP | 8.3 cP | 7.3 cP | 10.4 cP |

Example 9. TL1A Antibody Properties

This Example describes properties of TL1A antibodies described herein.

TL1A antibodies described herein were evaluated in multiple in vitro and ex vivo assays compared to other anti-TL1A mAbs (MK-7240, RVT-3101, and TEV-48574). Binding affinity to soluble TL1A was determined by surface plasmon resonance (SPR) and binding to membrane-bound TL1A was confirmed by flow cytometry. Competitive blockade of TL1A binding to cell-surface DR3 was determined by flow cytometry, and competition against the decoy receptor, DcR3, was evaluated by ELISA.

Various parameters including half-life, viscosity, solubility, and IFNγ release in whole blood were measured of TL1A antibodies including Antibody 10 and Antibody 63 as compared to RVT-3101, MK-7240, and TEV-48574.

The data is summarized in Table 9 and FIGS. 7A-7F. The data shows that the TL1A antibodies are highly stable following accelerated stress testing and have cleaner profiles compared to MK-7240 that exhibited fragmentation and RVT-3101 that exhibited chemical stability issues. Antibody 63 exhibited a 2-3× increased half-life in non-human primates (NHPs). Antibody 10 exhibited a 2-3× increased half-life in non-human primates (NHPs).

| Parameter | Antibody 10 | Antibody 63 | RVT-3101 | MK-7240 | TEV-48574 |
|---|---|---|---|---|---|
| NHP PK $t_{1/2}$ | ~24-27 days | ~24-28 days | ~7-13 days | ~10-12 days- | ~6 days |
| Human TL1A $K_D$ | 280 pM | 250 pM | 600 pM | 640 pM | 430 pM |
| Viscosity (150 g/L) | 7.1 cP | 10.5 cP | 8.3 cP | 7.3 cP | 10.4 cP |
| Solubility | >200 mg/mL | >200 mg/mL | >200 mg/mL | >200 mg/mL | ~155 mg/mL |
| pI | 8.8 | 8.7 | 9.0 | 8.7 | 7.0 |
| $T_{onset}$ | 59° C. | 59° C. | 66° C. | 60° C. | 59° C. |
| Thermal Stability (D%/week) | SEC: -0.7 ICIEF: -6.3 CE-SDS: -0.7 PTM, CDR: N/A | SEC: -0.5 ICIEF: -6.6 CE-SDS: -1.3 PTM, CDR: N/A | SEC: -0.4 ICIEF: -9.4 CE-SDS: -0.6 N55: +0.6 M63: +0.9 N100: +4.7 | SEC: -0.7 ICIEF: -8.2 CE-SDS: -4.5 PTM, CDR: N/A | SEC: NT ICIEF: NT CE-SDS: NT PTM (CDR): NT |
| pH Stability, Acidic (D%/day) | SEC: -3.2 ICIEF: 0.5 | SEC: -4.5 ICIEF: -0.7 | SEC: -2.4 ICIEF: -5.0 | SEC: -7.2 ICIEF: -2.0 | SEC: NT ICIEF: NT |
| pH Stability, Basic (D%/day) | SEC: -1.5 ICIEF: -3.1 | SEC: -2.6 ICIEF: -4.5 | SEC: -2.8 ICIEF: -14.3 | SEC: -2.9 ICIEF: -4.3 | SEC: NT ICIEF: NT |
| Binds monomer mutant | No | Yes ($K_D$ 170 pM) | No | Yes ($K_D$ 130 pM) | |

-continued

| Parameter | Antibody 10 | Antibody 63 | RVT-3101 | MK-7240 | TEV-48574 |
|---|---|---|---|---|---|
| Relative DR3 $IC_{50}$ | 0.98 | 1.2 | 1 | 33 | |
| Relative DcR3 $IC_{50}$ | 2.8 | 7.2 | 1 | 51 | |
| Relative TF-1 $IC_{50}$ | 0.86 | 0.53 | 1 | 4.9 | |
| Relative IFNγ $IC_{50}$ | 0.39 | 0.21 | 1 | 6.85 | |
| Species cross-reactivity | Hu, Cy, Pig, Dog | Hu, Cy, Rt, Pig, Dog | Hu, Cy, Rt, Rb, Pig, Dog | Hu, Cy, Rb, Pig, Dog | |

Example 9. Epitope Mapping of TL1A Antibodies

This Example describes the epitope mapping of TL1A antibodies described herein.

Figure 8A:
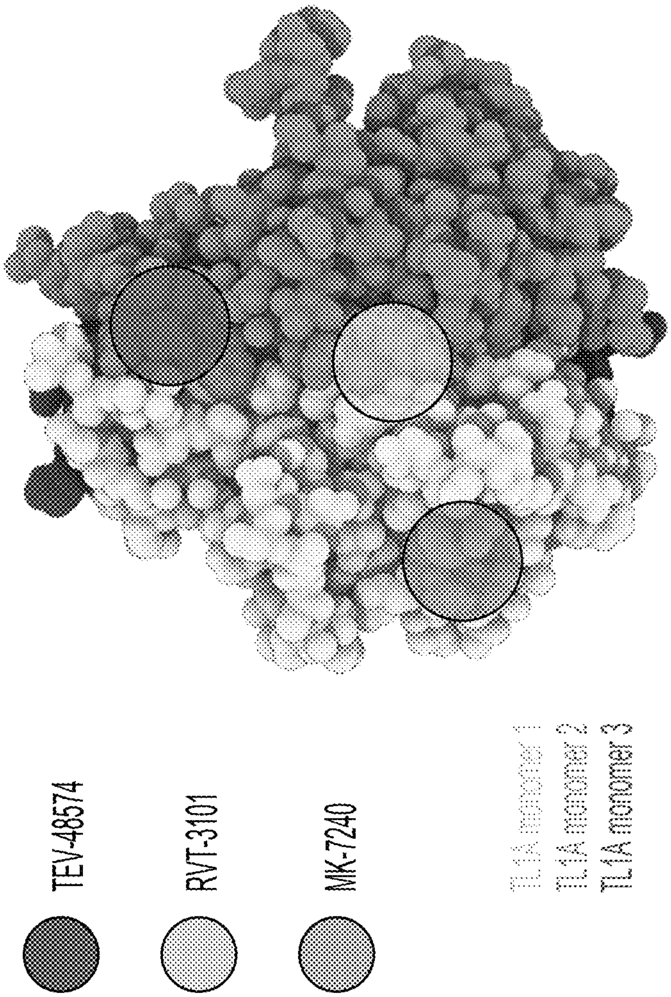
FIG. 8A depicts a CryoEM image of epitope for comparator TL1A binding antibodies.
Figure 8B:
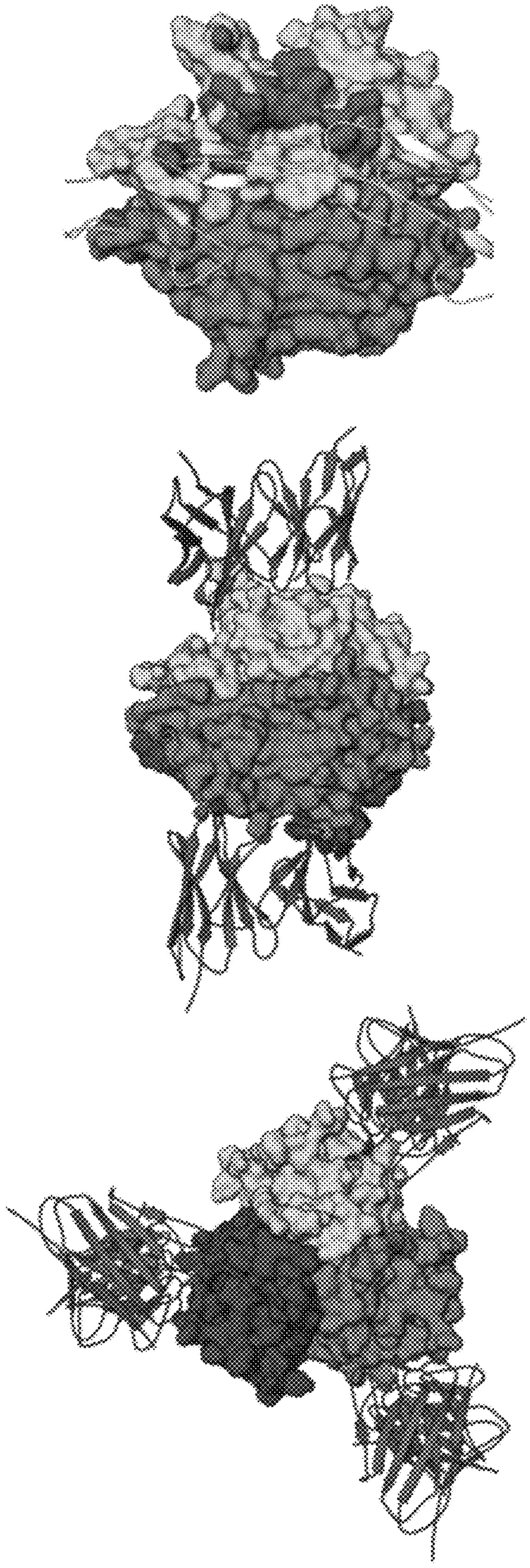
FIG. 8B depicts a CryoEM image of epitope for TL1A binding antibody 10.

The epitope binding of Antibody 10 to TL1A was determined using cryogenic electron microscopy. The data is seen in Table 10. Antibody 5, Antibody 6, Antibody 7, Antibody 8, and Antibody 9 were also found to bind to an epitope on a single TL1A subunit distinct from RVT-3101 and TEV-48574. See also FIGS. 8A-8B.

TABLE 10

| Type | Antibody 10 | TL1A amino acid residue of SEQ ID NO: 2493 | Energy | Distance (Angstrom) |
|---|---|---|---|---|
| D | LC Ser32 | Val102 | -0.38 | 3.86 |
| D | LC Tyr33 | Val102 | -0.76 | 3.89 |
| D | HC Trp104 | Val102 | -0.05 | 3.71 |
| D | HC Trp33 | Arg103 | -2.59 | 3.93 |
| D | LC Tyr33 | Arg103 | 0.16 | 3.94 |
| DH | HC Asp101 | Arg103 | -0.09 | 4.1 |
| DH | HC Leu102 | Arg103 | -0.69 | 3.95 |
| D | HC Gly103 | Arg103 | 0.84 | 3.78 |
| DH | HC Trp104 | Arg103 | -2.88 | 3.78 |
| DH | HC Trp104 | Gln104 | -0.67 | 4.15 |
| D | HC Asn31 | Thr105 | 0.39 | 3.79 |
| D | HC Ala32 | Thr105 | -0.27 | 4.37 |
| DH | HC Glu1 | Thr107 | -2.58 | 3.76 |
| D | HC Val2 | Thr 107 | -0.15 | 4.42 |
| D | HC Gly26 | Thr107 | -0.02 | 4.27 |
| D | HC Phe27 | Thr107 | -0.11 | 3.96 |
| DH | HC Thr28 | Thr107 | 0.22 | 3.48 |
| D | HC Tyr108 | Thr107 | -0.24 | 4.19 |
| D | HC Gly26 | Gln108 | 0.03 | 3.88 |

TABLE 10-continued

| Type | Antibody 10 | TL1A amino acid residue of SEQ ID NO: 2493 | Energy | Distance (Angstrom) |
|---|---|---|---|---|
| D | HC Phe27 | Gln108 | -0.09 | 3.86 |
| D | HC Thr28 | Gln108 | -0.06 | 4.04 |
| DH | LC Ser32 | His118 | -1.96 | 3.72 |
| DA | HC Trp104 | His118 | -1.9 | 3.9 |
| D | LC Ser32 | Trp119 | 0 | 4.48 |
| DH | LC Ser30 | Glu120 | -4.02 | 3.79 |
| D | LC Ser32 | Glu120 | 0 | 4.23 |
| DH | LC Arg28 | Glu122 | -2.82 | 3.87 |
| DH | LC Ser31 | Glu122 | -3.17 | 3.94 |
| H | LC Ser68 | Glu122 | -0.7 | 3.8 |
| D | LC Arg28 | Leu123 | -0.42 | 4.09 |
| D | LC Val29 | Leu123 | -0.25 | 4.21 |
| D | LC Ser30 | Leu123 | -0.79 | 4.14 |
| D | LC Arg28 | Gly 124 | 0.12 | 4.19 |
| D | HC Trp104 | Lys 137 | -0.55 | 4 |
| DH | HC Ile55 | Arg156 | -2.62 | 3.9 |
| DIH | HC Asp56 | Arg156 | -16.13 | 3.78 |
| D | HC Ile55 | Gly 157 | -0.55 | 4.14 |
| D | HC Lys54 | Met158 | -0.43 | 3.92 |
| D | HC Ile55 | Met158 | -0.8 | 4.01 |
| D | HC Asn31 | Ser234 | 0.21 | 4.04 |
| D | HC Trp33 | Tyr238 | -0.52 | 4.1 |
| D | HC Ser53 | Tyr238 | -0.02 | 3.72 |

TABLE 10-continued

| Type | Antibody 10 | TL1A amino acid residue of SEQ ID NO: 2493 | Energy | Distance (Angstrom) |
|---|---|---|---|---|
| D | HC Ile55 | Tyr238 | -0.15 | 3.96 |
| D | HC Asp56 | Tyr238 | 3.49 | 3.66 |
| D | HC Asp56 | Thr239 | 0.16 | 3.89 |

D = distance; H = hydrogen bond; I = ionic/salt bridge; A = aromatic/stacking

Open-source Software PyMol was used to identify and output a list of the epitope residues in soluble TL1A polypeptide for binding for TL1A binding antibodies described herein. Soluble TL1A polypeptide amino acid sequence is underlined in Table 11 below and corresponds to Leu72-Leu251 of SEQ ID NO: 2393.

TABLE 11

| Name | SEQ ID NO. | Sequence |
|---|---|---|
| Human TL1A (TNF15)-1 | 2493 | MAEDLGLSFGETASVEMLPEHGSCRPKARSS<br>SARWALTCCLVLLPFLAGLTTYLLVSQLRAQ<br>GEACVQFQALKGQEFAPSHQQVYAPLRADGD<br>KPRAHLTVVRQTPTQHFKNQFPALHWEHELG<br>LAFTKNRMNYTNKFLLIPESGDYFIYSQVTF<br>RGMTSECSEIRQAGRPNKPDSITVVITKVTD<br>SYPEPTQLLMGTKSVCEVGSNWFQPIYLGAM<br>FSLQEGDKLMVNVSDISLVDYTKEDKTFFGA<br>FLL |

Open-source Software PyMol was used to identify and output a list of epitope residues of the soluble TL1A polypeptide that bind Antibodies 6, 8 and 10 (Table 12), Antibodies 1-4 (Table 13) and Antibodies 47, 49, 63 and 69 (Table 14) based on the cryoEM structures. Table 12 shows TL1A epitopes for Antibodies 6, 8 and 10.

TABLE 12

| ANTIBODY No. | 6 | 8 | 10 |
|---|---|---|---|
| TL1A EPITOPE RESIDUES** | SER163 (SER234) | TYR167 (TYR238) | SER163 (SER234) |
| | TYR167 (TYR238) | VAL30 (VAL101) | TYR167 (TYR238) |
| | THR168 (THR239) | VAL31 (VAL102) | THR168 (THR239) |
| | VAL31 (VAL102) | ARG32 (ARG103) | VAL30 (VAL101) |
| | ARG32 (ARG103) | GLN33 (GLN104) | VAL31 (VAL102) |
| | GLN33 (GLN104) | THR34 (THR105) | ARG32 (ARG103) |
| | PRO35 (PRO106) | GLN37 (GLN108) | GLN33 (GLN104) |
| | HIS47 (HIS118) | GLU49 (GLU120) | THR34 (THR105) |
| | GLU49 (GLU120) | GLU51 (GLU122) | PRO35 (PRO106) |
| | GLU51 (GLU122) | LEU52 (LEU123) | HIS47 (HIS118) |
| | LEU52 (LEU123) | LYS66 (LYS137) | GLU49 (GLU120) |
| | GLY53 (GLY124) | ARG85 (ARG156) | GLU51 (GLU122) |
| | ASN65 (ASN136) | GLY86 (GLY157) | LEU52 (LEU123) |
| | ARG85 (ARG156) | MET87 (MET158) | GLY53 (GLY124) |
| | GLY86 (GLY157) | | ARG85 (ARG156) |
| | MET87 (MET158) | | |

**corresponding amino acid residues of SEQ ID No.: 2493 noted in parenthesis

Table 13 shows TL1A epitopes for Antibodies 1-4.

TABLE 13

| ANTIBODY No. | 1 | 2 | 3 | 4 |
|---|---|---|---|---|
| TL1A EPITOPE RESIDUES** | SER135 (SER206) | PRO100 (PRO171) | LYS102 (LYS173) | TYR117 |
| | ASN136 (ASN207) | LYS102 (LYS173) | ASP104 (ASP175) | GLU119 |
| | SER163 (SER234) | ASP104 (ASP175) | SER105 (SER176) | PRO120 |
| | LEU164 (LEU235) | GLN122 (GLN193) | VAL130 (VAL201) | THR121 |
| | VAL165 (VAL236) | SER135 (SER206) | SER135 (SER206) | GLN122 (GLN193) |
| | ASP166 (ASP237) | ASN136 (ASN207) | ASN136 (ASN207) | THR168 (THR239) |
| | TYR167 (TYR238) | SER160 (SER231) | TRP137 (TRP208) | LYS169 (LYS240) |
| | THR168 (THR239) | ASP161 (ASP232) | PHE138 (PHE209) | GLU170 (GLU241) |
| | LYS169 (LYS240) | ILE162 (ILE233) | ASP161 (ILE233) | ASP171 (ASP242) |
| | VAL30 (VAL101) | SER163 (SER234) | ILE162 (ILE233) | VAL30 (VAL101) |
| | VAL31 (VAL102) | LEU164 (LEU235) | SER163 (SER234) | VAL31 (VAL102) |
| | ARG32 (ARG103) | VAL165 (VAL236) | LEU164 (LEU235) | ARG32 (ARG103) |
| | GLN33 (GLN104) | ASP166 (ASP237) | VAL165 (VAL236) | GLN33 (GLN104) |
| | THR34 (THR105) | TYR167 (TYR238) | ASP166 (ASP237) | HIS47 (HIS118) |
| | PRO35 (PRO106) | THR168 (THR239) | TYR167 (TYR238) | TRP48 (TRP119) |
| | THR36 (THR107) | LYS169 (LYS240) | THR168 (THR239) | GLU49 (GLU120) |

TABLE 13-continued

| ANTIBODY No. | 1 | 2 | 3 | 4 |
|---|---|---|---|---|
| | HIS47<br>(HIS118) | LYS172<br>(LYS243) | LYS169<br>(LYS240) | HIS50<br>(HIS121) |
| | TRP48<br>(TRP119) | ARG32<br>(ARG103) | LYS172<br>(LYS243) | GLU51<br>(GLU122) |
| | GLU49<br>(GLU120) | GLN33<br>(GLN104) | VAL31<br>(VAL102) | LEU52<br>(LEU123) |
| | HIS50<br>(HIS121) | THR34<br>(THR105) | ARG32<br>(ARG103) | GLY53<br>(GLY124) |
| | GLU51<br>(HIS122) | PRO35<br>(PRO106) | GLN33<br>(GLN104) | TYR63<br>(TYR134) |
| | LEU52<br>(LEU123) | THR36<br>(THR107) | THR34<br>(THR105) | THR64<br>(THR135) |
| | GLY53<br>(GLY124) | GLN37<br>(GLN108) | PRO35<br>(PRO106) | |
| | TYR63<br>(TYR134) | HIS38<br>(HIS109) | THR36<br>(THR107) | |
| | ASN65<br>(ASN136) | PHE39<br>(PHE110) | GLN37<br>(GLN108) | |
| | ARG85<br>(ARG156) | LYS40<br>(LYS111) | HIS38<br>(HIS109) | |
| | GLY86<br>(GLY157) | PRO44<br>(PRO115) | ASN41<br>(ASN112) | |
| | MET87<br>(MET158) | ARG85<br>(ARG156) | PRO44<br>(PRO115) | |
| | THR88<br>(THR159) | MET87<br>(MET158) | LEU46<br>(LEU117) | |
| | | THR88<br>(THR159) | ARG85<br>(ARG156) | |
| | | SER89<br>(SER160) | GLY86<br>(GLY157) | |
| | | GLU90<br>(GLU161) | MET87<br>(MET158) | |
| | | ALA97<br>(ALA168) | THR 88<br>(THR 159) | |
| | | GLY98<br>(GLY169) | SER89<br>(SER160) | |
| | | ARG99<br>(ARG170) | GLU90<br>(GLU161) | |
| | | | ARG99<br>(ARG170) | |

**corresponding amino acid residues of SEQ ID No.: 2493 noted in parenthesis

Table 14 shows TL1A epitopes for Antibodies 47, 49, 63 and 69.

TABLE 14

| ANTIBODY No. | 47 | 49 | 63 | 69 |
|---|---|---|---|---|
| TL1A EPITOPE RESIDUES** | LYS102<br>(LYS173) | LYS102<br>(LYS173) | LYS102<br>(LYS173) | ASP161<br>(ASP232) |
| | MET125<br>(MET196) | SER135<br>(SER206) | SER160<br>(SER231) | ILE162<br>(ILE233) |
| | SER135<br>(SER206) | ASN136<br>(ASN207) | ASP161<br>(ASP232) | SER163<br>(SER234) |
| | SER160<br>(SER231) | SER160<br>(SER231) | ILE162<br>(ILE233) | LEU164<br>(LEU235) |
| | ASP161<br>(ASP232) | ASP161<br>(ASP232) | SER163<br>(SER234) | VAL165<br>(VAL236) |
| | ILE162<br>(ILE233) | ILE162<br>(ILE233) | LEU164<br>(LEU235) | ASP166<br>(ASP237) |
| | SER163<br>(SER234) | SER163<br>(SER234) | VAL165<br>(VAL236) | TYR167<br>(TYR238) |
| | LEU164<br>(LEU235) | LEU164<br>(LEU235) | ASP166<br>(ASP237) | THR168<br>(THR239) |
| | VAL165<br>(VAL236) | VAL165<br>(VAL236) | TYR167<br>(TYR238) | LYS169<br>(LYS240) |
| | ASP166<br>(ASP237) | ASP166<br>(ASP237) | THR168<br>(THR239) | LYS172<br>(LYS243) |
| | TYR167<br>(TYR238) | TYR167<br>(TYR238) | LYS169<br>(LYS240) | THR29<br>(THR100) |
| | THR168<br>THR239) | THR168<br>(THR239) | LYS172<br>(LYS243) | VAL30<br>(VAL101) |
| | LYS169<br>(LYS240) | LYS169<br>(LYS240) | VAL30<br>(VAL101) | VAL31<br>(VAL102) |
| | LYS172<br>(LYS243) | LYS172<br>(LYS243) | VAL31<br>(VAL102) | ARG32<br>(ARG103) |
| | VAL30<br>(VAL101) | VAL30<br>(VAL101) | ARG32<br>(ARG103) | GLN33<br>(GLN104) |
| | VAL31<br>(VAL102) | VAL31<br>(VAL102) | GLN33<br>(GLN104) | THR34<br>(THR105) |
| | ARG32<br>(ARG103) | ARG32<br>(ARG103) | THR34<br>(THR105) | PRO35<br>(PRO106) |
| | GLN33<br>(GLN104) | GLN33<br>(GLN104) | PRO35<br>(PRO106) | THR36<br>(THR107) |
| | THR34<br>(THR105) | THR34<br>(THR105) | THR36<br>(THR107) | GLN37<br>(GLN108) |
| | PRO35<br>(PRO106) | PRO35<br>(PRO106) | GLN37<br>(GLN108) | HIS38<br>(HIS109) |
| | THR36<br>(THR107) | THR36<br>(THR 107) | HIS38<br>(HIS109) | PHE39<br>(PHE110) |
| | GLN37<br>(GLN108) | GLN37<br>(GLN108) | PHE39<br>(PHE110) | LYS40<br>(LYS111) |
| | HIS38<br>(HIS109) | HIS38<br>(HIS109) | LYS40<br>(LYS111) | GLN42<br>(GLN113) |
| | PHE39<br>(PHE110) | PHE39<br>(PHE110) | LEU46<br>(LEU117) | PRO44<br>(PRO115) |
| | LYS40<br>(LYS111) | LYS40<br>(LYS111) | HIS47<br>(HIS118) | HIS47<br>(HIS118) |
| | LEU46<br>(LEU117) | GLN42<br>(GLN113) | TRP48<br>(TRP119) | TRP48<br>(TRP119) |
| | HIS47<br>(HIS118) | PRO44<br>(PRO115) | ARG85<br>(ARG156) | GLU49<br>(GLU120) |
| | TRP48<br>(TRP119) | LEU46<br>(LEU117) | MET87<br>(MET158) | ARG85<br>(ARG156) |

TABLE 14-continued

| ANTIBODY No. | 47 | 49 | 63 | 69 |
|---|---|---|---|---|
| | ARG85 (ARG156) | HIS47 (HIS118) | ARG99 (ARG170) | MET87 (MET158) |
| | GLY86 (GLY157) | TRP48 (TRP119) | | |
| | MET87 (MET158) | ARG85 (ARG156) | | |
| | ARG99 (ARG170) | MET87 (MET158) | | |

**corresponding amino acid residues of SEQ ID No.: 2493 noted in parenthesis

INCORPORATION BY REFERENCE

All publications, patents, and patent applications mentioned in this specification are herein incorporated by reference to the same extent as if each individual publication, patent, or patent application was specifically and individually indicated to be incorporated by reference.

EQUIVALENTS

The disclosure may be embodied in other specific forms without departing from the spirit or essential characteristics thereof. The foregoing embodiments are therefore to be considered in all respects illustrative rather than limiting the disclosure described herein. Scope of the disclosure is thus indicated by the appended claims rather than by the foregoing description, and all changes that come within the meaning and range of equivalency of the claims are intended to be embraced therein.

SEQUENCE LISTING (2595 sequences)

SEQ ID NO: 1 - protein, 5 aa, synthetic construct
SYAMH

SEQ ID NO: 2 - protein, 5 aa, synthetic construct
SYYWS

SEQ ID NO: 3 - protein, 5 aa, synthetic construct
TYNMN

SEQ ID NO: 4 - protein, 7 aa, synthetic construct
SNSATWN

SEQ ID NO: 5 - protein, 5 aa, synthetic construct
NVWMN

SEQ ID NO: 6 - protein, 5 aa, synthetic construct
NVWMN

SEQ ID NO: 7 - protein, 5 aa, synthetic construct
NAWMS

SEQ ID NO: 8 - protein, 5 aa, synthetic construct
NAWMS

SEQ ID NO: 9 - protein, 5 aa, synthetic construct
NAWMT

SEQ ID NO: 10 - protein, 5 aa, synthetic construct
NAWMT

SEQ ID NO: 11 - protein, 17 aa, synthetic construct
VVSYEGSQNYYADSVKG

SEQ ID NO: 12 - protein, 16 aa, synthetic construct
LIYYSGSTNYNPSLKS

SEQ ID NO: 13 - protein, 17 aa, synthetic construct
SIHSSSNYLYYADSVKG

SEQ ID NO: 14 - protein, 18 aa, synthetic construct
RTYYRSKWYNDYAVSVKS

SEQ ID NO: 15 - protein, 19 aa, synthetic construct
LIKSKTDAGTTDYAAPVKG

SEQ ID NO: 16 - protein, 19 aa, synthetic construct
RIKSKIDAGTTDYVAPVKG

SEQ ID NO: 17 - protein, 19 aa, synthetic construct
RIKSKIDAGTTDYAAPVKG

SEQ ID NO: 18 - protein, 19 aa, synthetic construct
RIKSKIDAGTTDYAAPVKG

SEQ ID NO: 19 - protein, 19 aa, synthetic construct
RIKSKIDAGTTDYAAPVKG

SEQ ID NO: 20 - protein, 19 aa, synthetic construct
RIKSKIDAGTTDYAAPVKG

SEQ ID NO: 21 - protein, 9 aa, synthetic construct
LESAYYFDY

SEQ ID NO: 22 - protein, 8 aa, synthetic construct
ADVVTIDY

SEQ ID NO: 23 - protein, 9 aa, synthetic construct
DRAMVDFDY

SEQ ID NO: 24 - protein, 11 aa, synthetic construct
EAVGPTKDFDY

SEQ ID NO: 25 - protein, 8 aa, synthetic construct
DRGWGENY

SEQ ID NO: 26 - protein, 8 aa, synthetic construct
DRGWGENY

SEQ ID NO: 27 - protein, 8 aa, synthetic construct
DLGWGENY

SEQ ID NO: 28 - protein, 8 aa, synthetic construct
DLGWGENY

SEQ ID NO: 29 - protein, 8 aa, synthetic construct
DLGWGENY

SEQ ID NO: 30 - protein, 8 aa, synthetic construct
DLGWGENY

SEQ ID NO: 31 - protein, 16 aa, synthetic construct
RSSQSLLYSNGYNSLD

SEQ ID NO: 32 - protein, 11 aa, synthetic construct
RASQTISSYFN

SEQ ID NO: 33 - protein, 11 aa, synthetic construct
RASQSISTYLN

SEQ ID NO: 34 - protein, 11 aa, synthetic construct
RASQSFSSYLN

SEQ ID NO: 35 - protein, 12 aa, synthetic construct
RASQIFSSSYLV

SEQ ID NO: 36 - protein, 12 aa, synthetic construct
RASQSVSSSYLV

SEQ ID NO: 37 - protein, 12 aa, synthetic construct
RASQSISRSYLV

SEQ ID NO: 38 - protein, 12 aa, synthetic construct
RASQRVSSSYLV

SEQ ID NO: 39 - protein, 12 aa, synthetic construct
RASQRVSSSYLV

SEQ ID NO: 40 - protein, 12 aa, synthetic construct
RASQRVSSSYLV

SEQ ID NO: 41 - protein, 7 aa, synthetic construct
LGSNRAS

SEQ ID NO: 42 - protein, 7 aa, synthetic construct
AASSLQS

SEQ ID NO: 43 - protein, 7 aa, synthetic construct
AASSLQS

SEQ ID NO: 44 - protein, 7 aa, synthetic construct
AASSLQS

SEQ ID NO: 45 - protein, 7 aa, synthetic construct
GASSRAT

SEQ ID NO: 46 - protein, 7 aa, synthetic construct
GASSRAT

SEQ ID NO: 47 - protein, 7 aa, synthetic construct
GASSRAT

SEQ ID NO: 48 - protein, 7 aa, synthetic construct
GASSRAT

SEQ ID NO: 49 - protein, 7 aa, synthetic construct
GASSRAT

SEQ ID NO: 50 - protein, 7 aa, synthetic construct
GASSRAT

SEQ ID NO: 51 - protein, 9 aa, synthetic construct
MQALQTPYT

SEQ ID NO: 52 - protein, 9 aa, synthetic construct
QQSYSTPIT

SEQ ID NO: 53 - protein, 9 aa, synthetic construct
QQSYSTPLT

SEQ ID NO: 54 - protein, 9 aa, synthetic construct
QQSYFTPRT

SEQ ID NO: 55 - protein, 9 aa, synthetic construct
QQYGNSPYT

SEQ ID NO: 56 - protein, 9 aa, synthetic construct
QQYGGSPYT

SEQ ID NO: 57 - protein, 9 aa, synthetic construct
HQYGSSPYT

SEQ ID NO: 58 - protein, 9 aa, synthetic construct
QQYGSSPYT

SEQ ID NO: 59 - protein, 9 aa, synthetic construct
QQYGSSPYT

SEQ ID NO: 60 - protein, 9 aa, synthetic construct
QQYGSSPYT

SEQ ID NO: 61 - protein, 7 aa, synthetic construct
GFTFSSY

SEQ ID NO: 62 - protein, 7 aa, synthetic construct
GGSISSY

SEQ ID NO: 63 - protein, 7 aa, synthetic construct
GFTFSTY

SEQ ID NO: 64 - protein, 9 aa, synthetic construct
GDSVSSNSA

SEQ ID NO: 65 - protein, 7 aa, synthetic construct
GFTFSNV

SEQ ID NO: 66 - protein, 7 aa, synthetic construct
GFIFSNV

SEQ ID NO: 67 - protein, 7 aa, synthetic construct
GFTFSNA

SEQ ID NO: 68 - protein, 7 aa, synthetic construct
GFTFSNA

SEQ ID NO: 69 - protein, 7 aa, synthetic construct
GFTFSNA

SEQ ID NO: 70 - protein, 7 aa, synthetic construct
GFTFSNA

SEQ ID NO: 71 - protein, 6 aa, synthetic construct
SYEGSQ

SEQ ID NO: 72 - protein, 5 aa, synthetic construct
YYSGS

SEQ ID NO: 73 - protein, 6 aa, synthetic construct
HSSSNY

SEQ ID NO: 74 - protein, 7 aa, synthetic construct
YYRSKWY

SEQ ID NO: 75 - protein, 8 aa, synthetic construct
KSKTDAGT

SEQ ID NO: 76 - protein, 8 aa, synthetic construct
KSKIDAGT

SEQ ID NO: 77 - protein, 8 aa, synthetic construct
KSKIDAGT

SEQ ID NO: 78 - protein, 8 aa, synthetic construct
KSKIDAGT

SEQ ID NO: 79 - protein, 8 aa, synthetic construct
KSKIDAGT

SEQ ID NO: 80 - protein, 8 aa, synthetic construct
KSKIDAGT

SEQ ID NO: 81 - protein, 7 aa, synthetic construct
ESAYYFD

SEQ ID NO: 82 - protein, 6 aa, synthetic construct
DVVTID

SEQ ID NO: 83 - protein, 7 aa, synthetic construct
RAMVDFD

SEQ ID NO: 84 - protein, 9 aa, synthetic construct
AVGPTKDFD

SEQ ID NO: 85 - protein, 6 aa, synthetic construct
RGWGEN

SEQ ID NO: 86 - protein, 6 aa, synthetic construct
RGWGEN

SEQ ID NO: 87 - protein, 6 aa, synthetic construct
LGWGEN

SEQ ID NO: 88 - protein, 6 aa, synthetic construct
LGWGEN

SEQ ID NO: 89 - protein, 6 aa, synthetic construct
LGWGEN

SEQ ID NO: 90 - protein, 6 aa, synthetic construct
LGWGEN

SEQ ID NO: 91 - protein, 12 aa, synthetic construct
SQSLLYSNGYNS

SEQ ID NO: 92 - protein, 7 aa, synthetic construct
SQTISSY

SEQ ID NO: 93 - protein, 7 aa, synthetic construct
SQSISTY

SEQ ID NO: 94 - protein, 7 aa, synthetic construct
SQSFSSY

SEQ ID NO: 95 - protein, 8 aa, synthetic construct
SQIFSSSY

SEQ ID NO: 96 - protein, 8 aa, synthetic construct
SQSVSSSY

SEQ ID NO: 97 - protein, 8 aa, synthetic construct
SQSISRSY

SEQ ID NO: 98 - protein, 8 aa, synthetic construct
SQRVSSSY

SEQ ID NO: 99 - protein, 8 aa, synthetic construct
SQRVSSSY

SEQ ID NO: 100 - protein, 8 aa, synthetic construct
SQRVSSSY

SEQ ID NO: 101-110 - skipped (10 entries)

SEQ ID NO: 111 - protein, 6 aa, synthetic construct
ALQTPY

SEQ ID NO: 112 - protein, 6 aa, synthetic construct
SYSTPI

SEQ ID NO: 113 - protein, 6 aa, synthetic construct
SYSTPL

SEQ ID NO: 114 - protein, 6 aa, synthetic construct
SYFTPR

SEQ ID NO: 115 - protein, 6 aa, synthetic construct
YGNSPY

SEQ ID NO: 116 - protein, 6 aa, synthetic construct
YGGSPY

SEQ ID NO: 117 - protein, 6 aa, synthetic construct
YGSSPY

SEQ ID NO: 118 - protein, 6 aa, synthetic construct
YGSSPY

SEQ ID NO: 119 - protein, 6 aa, synthetic construct
YGSSPY

SEQ ID NO: 120 - protein, 6 aa, synthetic construct
YGSSPY

SEQ ID NO: 121 - protein, 8 aa, synthetic construct
GFTFSSYA

SEQ ID NO: 122 - protein, 8 aa, synthetic construct
GGSISSYY

SEQ ID NO: 123 - protein, 8 aa, synthetic construct
GFTFSTYN

SEQ ID NO: 124 - protein, 10 aa, synthetic construct
GDSVSSNSAT

SEQ ID NO: 125 - protein, 8 aa, synthetic construct
GFTFSNVW

SEQ ID NO: 126 - protein, 8 aa, synthetic construct
GFIFSNVW

SEQ ID NO: 127 - protein, 8 aa, synthetic construct
GFTFSNAW

SEQ ID NO: 128 - protein, 8 aa, synthetic construct
GFTFSNAW

SEQ ID NO: 129 - protein, 8 aa, synthetic construct
GFTFSNAW

SEQ ID NO: 130 - protein, 8 aa, synthetic construct
GFTFSNAW

SEQ ID NO: 131 - protein, 8 aa, synthetic construct
VSYEGSQN

SEQ ID NO: 132 - protein, 7 aa, synthetic construct
IYYSGST

SEQ ID NO: 133 - protein, 8 aa, synthetic construct
IHSSSNYL

SEQ ID NO: 134 - protein, 9 aa, synthetic construct
TYYRSKWYN

SEQ ID NO: 135 - protein, 10 aa, synthetic construct
IKSKTDAGTT

SEQ ID NO: 136 - protein, 10 aa, synthetic construct
IKSKIDAGTT

SEQ ID NO: 137 - protein, 10 aa, synthetic construct
IKSKIDAGTT

SEQ ID NO: 138 - protein, 10 aa, synthetic construct
IKSKIDAGTT

SEQ ID NO: 139 - protein, 10 aa, synthetic construct
IKSKIDAGTT

SEQ ID NO: 140 - protein, 10 aa, synthetic construct
IKSKIDAGTT

SEQ ID NO: 141 - protein, 11 aa, synthetic construct
ANLESAYYFDY

SEQ ID NO: 142 - protein, 10 aa, synthetic construct
ARADVVTIDY

SEQ ID NO: 143 - protein, 11 aa, synthetic construct
ATDRAMVDFDY

SEQ ID NO: 144 - protein, 13 aa, synthetic construct
AREAVGPTKDFDY

SEQ ID NO: 145 - protein, 10 aa, synthetic construct
TTDRGWGENY

SEQ ID NO: 146 - protein, 10 aa, synthetic construct
ITDRGWGENY

SEQ ID NO: 147 - protein, 10 aa, synthetic construct
TTDLGWGENY

SEQ ID NO: 148 - protein, 10 aa, synthetic construct
TTDLGWGENY

SEQ ID NO: 149 - protein, 10 aa, synthetic construct
TTDLGWGENY

SEQ ID NO: 150 - protein, 10 aa, synthetic construct
TTDLGWGENY

SEQ ID NO: 151 - protein, 11 aa, synthetic construct
QSLLYSNGYNS

SEQ ID NO: 152 - protein, 6 aa, synthetic construct
QTISSY

SEQ ID NO: 153 - protein, 6 aa, synthetic construct
QSISTY

SEQ ID NO: 154 - protein, 6 aa, synthetic construct
QSFSSY

SEQ ID NO: 155 - protein, 7 aa, synthetic construct
QIFSSSY

SEQ ID NO: 156 - protein, 7 aa, synthetic construct
QSVSSSY

SEQ ID NO: 157 - protein, 7 aa, synthetic construct
QSISRSY

SEQ ID NO: 158 - protein, 7 aa, synthetic construct
QRVSSSY

SEQ ID NO: 159 - protein, 7 aa, synthetic construct
QRVSSSY

SEQ ID NO: 160 - protein, 7 aa, synthetic construct
QRVSSSY

SEQ ID NO: 161-170 - skipped (10 entries)

SEQ ID NO: 171 - protein, 9 aa, synthetic construct
MQALQTPYT

SEQ ID NO: 172 - protein, 9 aa, synthetic construct
QQSYSTPIT

SEQ ID NO: 173 - protein, 9 aa, synthetic construct
QQSYSTPLT

SEQ ID NO: 174 - protein, 9 aa, synthetic construct
QQSYFTPRT

SEQ ID NO: 175 - protein, 9 aa, synthetic construct
QQYGNSPYT

SEQ ID NO: 176 - protein, 9 aa, synthetic construct
QQYGGSPYT

SEQ ID NO: 177 - protein, 9 aa, synthetic construct
HQYGSSPYT

SEQ ID NO: 178 - protein, 9 aa, synthetic construct
QQYGSSPYT

SEQ ID NO: 179 - protein, 9 aa, synthetic construct
QQYGSSPYT

SEQ ID NO: 180 - protein, 9 aa, synthetic construct
QQYGSSPYT

SEQ ID NO: 181 - protein, 118 aa, synthetic construct
QVKLVESGGGVVQPGRSLRLSCAASGFTFSSYAMHWVRQAPGKGLEWVAVVSYEGSQNYYADSVKGRFTISRDNSKNTLYLQMNSLRAEDTAVYYCANLESAYYFDYWGQGTLVTVSS

SEQ ID NO: 182 - protein, 116 aa, synthetic construct
QVQLQESGPGLVKPSETLSLTCTVSGGSISSYYWSWIRQPPGKGLEWIGLIYYSGSTNYNPSLKSRVTISVDTSKNQFSLKLSSVTAADTAVYYCARADVVTIDYWGQGTLVTVSS

SEQ ID NO: 183 - protein, 118 aa, synthetic construct
EVQLVESGGGLVKPGGSLRLSCAASGFTFSTYNMNWVRQAPGKGLEWISSIHSSSNYLYYADSVKGRFTISRDNAKNSLYLQMNSLRAEDTAVYYCATDRAMVDFDYWGQGTLVTVSS

SEQ ID NO: 184 - protein, 123 aa, synthetic construct
QVQLQQSGPGLVKPSQTLSLTCAISGDSVSSNSATWNWIRQSPSRGLEWLGRTYYRSKWYNDYAVSVKSRLTINPDTSKNQFSLQLNSVTPEDTAVYYCAREAVGPTKDFDYWGQGTLVPVSS

SEQ ID NO: 185 - protein, 119 aa, synthetic construct
EVQLVESGGGLVKPGGSLRLSCAAFGFTFSNVWMNWVRQAPGKGLEWVGLIKSKTDAGTTDYAAPVKGRFTISRDDSKNMLYLQMNSLKTEDTAVYYCTTDRGWGENYWGQGTLVTVSS

SEQ ID NO: 186 - protein, 119 aa, synthetic construct
EVQLVESGGGLVKPGGSLRLSCAASGFIFSNVWMNWVRQAPGKGLEWVGRIKSKIDAGTTDYVAPVKGRFTISRDDSKNTLSLQMNSLKTEDTAVYYCITDRGWGENYWGQGTLVTVSS

SEQ ID NO: 187 - protein, 119 aa, synthetic construct
EVQLVESGGGLVKPGGSLRLSCAASGFTFSNAWMSWVRQAPGKGLEWVGRIKSKIDAGTTDYAAPVKGRFTISRDDSRNTLYLQMNSLRTEDTADYYCTTDLGWGENYWGQGTLVTVSS

SEQ ID NO: 188 - protein, 119 aa, synthetic construct
EVQLVESGGGLVKPGGSLRLSCAASGFTFSNAWMSWVRQAPGKGLEWVGRIKSKIDAGTTDYAAPVKGRFTISRDDSKNTLYLQMNSLKTEDTAVYYCTTDLGWGENYWGQGTLVTVSS

SEQ ID NO: 189 - protein, 119 aa, synthetic construct
EVQLVESGGGLVKPGGSLRLSCAASGFTFSNAWMTWVRQAPGKGLEWVGRIKSKIDAGTTDYAAPVKGRFTISRYDSKNTLYLQMNSLKTEDTAVYYCTTDLGWGENYWGQGTLVTVSS

SEQ ID NO: 190 - protein, 119 aa, synthetic construct
EVQLVESGGGLVKPGGSLRLSCAASGFTFSNAWMTWVRQAPGKGLEWVGRIKSKIDAGTTDYAAPVKGRFTISRDDSKNTLYLQMNSLKTEDTAVYYCTTDLGWGENYWGQGTLVTVSS

SEQ ID NO: 191 - protein, 112 aa, synthetic construct
DIVMTQSPLSLPVTPGEPASISCRSSQSLLYSNGYNSLDWYLQKTGQSPQLLIYLGSNRASGVPDRFSGSGSGTDFTLKISRVEAEDVGVYYCMQALQTPYTFGQGTKLEIK

SEQ ID NO: 192 - protein, 107 aa, synthetic construct
DIQMTQSPSSLSASVGDRVTITCRASQTISSYFNWYQQKAGEAPKLLIYAASSLQSGVPSRFSGSGSGTDFTLTISSLQPEDFATYYCQQSYSTPITFGQGTRLEIK

SEQ ID NO: 193 - protein, 107 aa, synthetic construct
DIQMTQSPSSLSASVGDRVTITCRASQSISTYLNWYQQKPGKAPKLLIYAASSLQSGVPSRFSGSGSGTDFTLTISSLQPEDFAAYYCQQSYSTPLTFGGGTRVEIK

SEQ ID NO: 194 - protein, 107 aa, synthetic construct
DIQMTQSPSSLSASVGDRVTITCRASQSFSSYLNWYQQTPGKAPKLLIYAASSLQSGVPSRFSGSGSGTYFTLTISSLQPEDLATYYCQQSYFTPRTFGQGTKVEIK

SEQ ID NO: 195 - protein, 108 aa, synthetic construct
ENVLTQSPGTLSLSPGERATLSCRASQIFSSSYLVWYQKKPGQAPRLLIYGASSRATGIPDRFSGSGSGTDFTLTISRLEPEDFAVYYCQQYGNSPYTFGQGTKLEIK

SEQ ID NO: 196 - protein, 108 aa, synthetic construct
EIVLTQSPGTLSLSPGERATLSCRASQSVSSSYLVWYQQKPGQAPRLLIYGASSRATGIPDRFSGSGSGTDFTFTISRLEPEDFAVYYCQQYGGSPYTFGQGTKLEIK

SEQ ID NO: 197 - protein, 108 aa, synthetic construct
EIVLTQSPGTLSLSPGERATLSCRASQSISRSYLVWYEQKPGQAPRLLIYGASSRATGIPDRFSGSGSGTDFTLTISRLEPEDFAVYYCHQYGSSPYTFGQGTKLEIK

SEQ ID NO: 198 - protein, 108 aa, synthetic construct
ENVLTQSPGTLSLSPGERATLSCRASQRVSSSYLVWYQQKPGQAPRLLIYGASSRATGIPDRFSGSGSGTDFTLTISRLEPEDFAVYYCQQYGSSPYTFGQGTKLESK

SEQ ID NO: 199 - protein, 108 aa, synthetic construct
ENVLTQSPGTLSLSPGERATLSCRASQRVSSSYLVWYQQKPGQAPRLLIYGASSRATGIPDRFSGSGSGTDFTLTISRLEPEDFAVYYCQQYGSSPYTFGQGTKLEIK

SEQ ID NO: 200 - protein, 108 aa, synthetic construct; identical to SEQ ID NO: 199

SEQ ID NO: 201 - protein, 329 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 202 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 203 - protein, 324 aa, unidentified
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 204 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEELGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 206 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 207 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 208 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 209 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 210 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 211 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 212 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 213 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 214 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 215 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 216 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 217 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 218 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 219 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPG

SEQ ID NO: 220 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPG

SEQ ID NO: 221 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPG

SEQ ID NO: 222 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPG

SEQ ID NO: 223 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPG

SEQ ID NO: 224 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPG

SEQ ID NO: 225 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPG

SEQ ID NO: 226 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPG

SEQ ID NO: 227 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVDHHDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPG

SEQ ID NO: 228 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVDHHDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPG

SEQ ID NO: 229 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPG

SEQ ID NO: 230 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPG

SEQ ID NO: 231 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPG

SEQ ID NO: 232 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPG

SEQ ID NO: 233 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLYITREPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 234 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLYITREPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 235 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEELGGPSVFLFPPKPKDTLYITREPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 236 - protein, 326 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVLHEALHSYTQKSLSLSLGK

SEQ ID NO: 237 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVLHEALHSHYTQKSLSLSLGK

SEQ ID NO: 238 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEELGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVLHEALHSHYTQKSLSLSLGK

SEQ ID NO: 239 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVDHHDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHSHYTQKSLSLSLGK

SEQ ID NO: 240 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVDHHDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHSHYTQKSLSLSLGK

SEQ ID NO: 241 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEELGGPSVFLFPPKPKDTLMISRTPEVTCVVVDVSQEDPEVQFNWYVDGVEVHNAKTKPREEQFNSTYRVVSVLTVDHHDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHSHYTQKSLSLSLGK

SEQ ID NO: 242 - protein, 324 aa, synthetic construct
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLYITREPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVLHEALHSHYTQKSLSLSP

SEQ ID NO: 243 - protein, 324 aa, synthetic construct; identical to SEQ ID NO: 203

SEQ ID NO: 244 - protein, 324 aa, synthetic construct
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVDHHDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHSHYTQKSLSLSP

SEQ ID NO: 245 - protein, 327 aa, synthetic construct; identical to SEQ ID NO: 204

SEQ ID NO: 246 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHAHYTQKSLSLSPG

SEQ ID NO: 247 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHAHYTQKSLSLSPG

SEQ ID NO: 248 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHAHYTQKSLSLSPG

SEQ ID NO: 249 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHAHYTQKSLSLSPG

SEQ ID NO: 250 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHAHYTQKSLSLSPG

SEQ ID NO: 251 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHAHYTQKSLSLSPG

SEQ ID NO: 252 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHAHYTQKSLSLSPG

SEQ ID NO: 253 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPG

SEQ ID NO: 254 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPG

SEQ ID NO: 255 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPG

SEQ ID NO: 256 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPG

SEQ ID NO: 257 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPG

SEQ ID NO: 258 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPG

SEQ ID NO: 259 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPG

SEQ ID NO: 260 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHWHYTQKSLSLSPG

SEQ ID NO: 261 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHWHYTQKSLSLSPG

SEQ ID NO: 262 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHWHYTQKSLSLSPG

SEQ ID NO: 263 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHWHYTQKSLSLSPG

SEQ ID NO: 264 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHWHYTQKSLSLSPG

SEQ ID NO: 265 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHWHYTQKSLSLSPG

SEQ ID NO: 266 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHWHYTQKSLSLSPG

SEQ ID NO: 267 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVDVSHEDPEVKFNWYVDGVEVHNAKTKPREEQYNSTYRVVSVLQVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 268 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVDVSHEDPEVKFNWYVDGVEVHNAKTKPREEQYASTYRVVSVLQVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 269 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVAVSHEDPEVKFNWYVDGVEVHNAKTKPREEQYNSTYRVVSVLQVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 270 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVHNAKTKPREEQYNSTYRVVSVLQVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 271 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRDPEVTCVVVDVSHEDPEVKFNWYVDGVEVHNAKTKPREEQYNSTYRVVSVLQVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 272 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRDPEVTCVVVDVSHEDPEVKFNWYVDGVEVHNAKTKPREEQYNSTYRVVSVLQVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 273 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVHNAKTKPREEQYNSTYRVVSVLQVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 274 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVDVSHEDPEVKFNWYVDGVEVHNAKTKPREEQYNSTYRVVSVLWVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 275 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVDVSHEDPEVKFNWYVDGVEVHNAKTKPREEQYASTYRVVSVLWVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 276 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVAVSHEDPEVKFNWYVDGVEVHNAKTKPREEQYNSTYRVVSVLWVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 277 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVHNAKTKPREEQYNSTYRVVSVLWVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 278 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRDPEVTCVVVDVSHEDPEVKFNWYVDGVEVHNAKTKPREEQYNSTYRVVSVLWVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 279 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRDPEVTCVVVDVSHEDPEVKFNWYVDGVEVHNAKTKPREEQYNSTYRVVSVLWVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 280 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVHNAKTKPREEQYNSTYRVVSVLWVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 281 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYISRDPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 282 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYISRDPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 283 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYISRDPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 284 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYISRDPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 285 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLYISRDPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 286 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLYISRDPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 287 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYISRDPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 288 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 289 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 290 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 291 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 292 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 293 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 294 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 295 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVDVSHEDPEVKFNWYVDGVEVDNAKTKPREEQYNSTYRVVSVLRVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 296 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVDVSHEDPEVKFNWYVDGVEVDNAKTKPREEQYASTYRVVSVLRVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 297 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVAVSHEDPEVKFNWYVDGVEVDNAKTKPREEQYNSTYRVVSVLRVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 298 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVDNAKTKPREEQYNSTYRVVSVLRVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 299 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRDPEVTCVVVDVSHEDPEVKFNWYVDGVEVDNAKTKPREEQYNSTYRVVSVLRVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 300 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRDPEVTCVVVDVSHEDPEVKFNWYVDGVEVDNAKTKPREEQYNSTYRVVSVLRVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 301 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVDNAKTKPREEQYNSTYRVVSVLRVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 302 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHRDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPG

SEQ ID NO: 303 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHRDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVLHEALHNHYTQKSLSLSLGK

SEQ ID NO: 304 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHRDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVLHEALHNHYTQKSLSLSLGK

SEQ ID NO: 305 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEELGGPSVFLFPPKPKDTLMISRTPEVTCVVVDVSQEDPEVQFNWYVDGVEVHNAKTKPREEQFNSTYRVVSVLTVLHRDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVLHEALHNHYTQKSLSLSLGK

SEQ ID NO: 306 - protein, 324 aa, synthetic construct
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHRDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVLHEALHNHYTQKSLSLSP

SEQ ID NO: 307 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHRDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPG

SEQ ID NO: 308 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHRDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPG

SEQ ID NO: 309 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHRDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPG

SEQ ID NO: 310 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHRDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPG

SEQ ID NO: 311 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHRDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPG

SEQ ID NO: 312 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHRDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPG

SEQ ID NO: 313 - protein, 5 aa, synthetic construct
GYYMH

SEQ ID NO: 314 - protein, 5 aa, synthetic construct
GYYWS

SEQ ID NO: 315 - protein, 5 aa, synthetic construct
GYYMH

SEQ ID NO: 316 - protein, 5 aa, synthetic construct
GYYMH

SEQ ID NO: 317 - protein, 5 aa, synthetic construct
GYYMH

SEQ ID NO: 318 - protein, 5 aa, synthetic construct
AYYMH

SEQ ID NO: 319 - protein, 5 aa, synthetic construct
AYYMH

SEQ ID NO: 320 - protein, 5 aa, synthetic construct
AYYMH

SEQ ID NO: 321 - protein, 5 aa, synthetic construct
AYYMH

SEQ ID NO: 322 - protein, 5 aa, synthetic construct
AYYIH

SEQ ID NO: 323 - protein, 5 aa, synthetic construct
AYYIH

SEQ ID NO: 324 - protein, 5 aa, synthetic construct
GYYLH

SEQ ID NO: 325 - protein, 5 aa, synthetic construct
GYYLH

SEQ ID NO: 326 - protein, 5 aa, synthetic construct
GYYMH

SEQ ID NO: 327 - protein, 5 aa, synthetic construct
GYYMH

SEQ ID NO: 328 - protein, 5 aa, synthetic construct
GYYLH

SEQ ID NO: 329 - protein, 5 aa, synthetic construct
GYYLH

SEQ ID NO: 330 - protein, 5 aa, synthetic construct
GYYMH

SEQ ID NO: 331 - protein, 5 aa, synthetic construct
GYYMH

SEQ ID NO: 332 - protein, 5 aa, synthetic construct
GYYMH

SEQ ID NO: 333 - protein, 5 aa, synthetic construct
GYYMH

SEQ ID NO: 334 - protein, 5 aa, synthetic construct
AYYIH

SEQ ID NO: 335 - protein, 5 aa, synthetic construct
AYYIH

SEQ ID NO: 336 - protein, 5 aa, synthetic construct
GYYMH

SEQ ID NO: 337 - protein, 5 aa, synthetic construct
GYYMH

SEQ ID NO: 338 - protein, 5 aa, synthetic construct
GYYMH

SEQ ID NO: 339 - protein, 5 aa, synthetic construct
AYYMH

SEQ ID NO: 340 - protein, 5 aa, synthetic construct
AYYMH

SEQ ID NO: 341 - protein, 5 aa, synthetic construct
AYYLH

SEQ ID NO: 342 - protein, 5 aa, synthetic construct
AYYLH

SEQ ID NO: 343 - protein, 5 aa, synthetic construct
GYFIH

SEQ ID NO: 344 - protein, 5 aa, synthetic construct
AYYMH

SEQ ID NO: 345 - protein, 5 aa, synthetic construct
AYYMH

SEQ ID NO: 346 - protein, 5 aa, synthetic construct
AYYIH

SEQ ID NO: 347 - protein, 5 aa, synthetic construct
AYYIH

SEQ ID NO: 348 - protein, 5 aa, synthetic construct
AYYIH

SEQ ID NO: 349 - protein, 5 aa, synthetic construct
AYYIH

SEQ ID NO: 350 - protein, 5 aa, synthetic construct
AYYMH

SEQ ID NO: 351 - protein, 5 aa, synthetic construct
AYYMH

SEQ ID NO: 352 - protein, 5 aa, synthetic construct
GYYIH

SEQ ID NO: 353 - protein, 5 aa, synthetic construct
GYYMH

SEQ ID NO: 354 - protein, 5 aa, synthetic construct
GYYMH

SEQ ID NO: 355 - protein, 5 aa, synthetic construct
GYYMH

SEQ ID NO: 356 - protein, 5 aa, synthetic construct
GYYMH

SEQ ID NO: 357 - protein, 5 aa, synthetic construct
GYFIH

SEQ ID NO: 358 - protein, 5 aa, synthetic construct
GYYMH

SEQ ID NO: 359 - protein, 5 aa, synthetic construct
GYYMH

SEQ ID NO: 360 - protein, 5 aa, synthetic construct
GYYMH

SEQ ID NO: 361 - protein, 5 aa, synthetic construct
GYYMH

SEQ ID NO: 362 - protein, 5 aa, synthetic construct
GYFMH

SEQ ID NO: 363 - protein, 5 aa, synthetic construct
GYFMH

SEQ ID NO: 364 - protein, 5 aa, synthetic construct
GYYMH

SEQ ID NO: 365 - protein, 5 aa, synthetic construct
GYYMH

SEQ ID NO: 366 - protein, 5 aa, synthetic construct
GYYMQ

SEQ ID NO: 367 - protein, 5 aa, synthetic construct
GYYMQ

SEQ ID NO: 368 - protein, 5 aa, synthetic construct
GYYLH

SEQ ID NO: 369 - protein, 5 aa, synthetic construct
GYYLH

SEQ ID NO: 370 - protein, 5 aa, synthetic construct
AYYMH

SEQ ID NO: 371 - protein, 5 aa, synthetic construct
AYYMH

SEQ ID NO: 372 - protein, 5 aa, synthetic construct
GYYMH

SEQ ID NO: 373 - protein, 5 aa, synthetic construct
GYYMH

SEQ ID NO: 374 - protein, 5 aa, synthetic construct
GYYMH

SEQ ID NO: 375 - protein, 5 aa, synthetic construct
GYYMH

SEQ ID NO: 376 - protein, 5 aa, synthetic construct
GYYMH

SEQ ID NO: 377 - protein, 5 aa, synthetic construct
GYYMH

SEQ ID NO: 378 - protein, 5 aa, synthetic construct
GYYIH

SEQ ID NO: 379 - protein, 5 aa, synthetic construct
GYYIH

SEQ ID NO: 380 - protein, 5 aa, synthetic construct
AYYMH

SEQ ID NO: 381 - protein, 5 aa, synthetic construct
AYYMH

SEQ ID NO: 382 - protein, 5 aa, synthetic construct
GYYMH

SEQ ID NO: 383 - protein, 5 aa, synthetic construct
GYYMH

SEQ ID NO: 384 - protein, 5 aa, synthetic construct
GYYMH

SEQ ID NO: 385 - protein, 5 aa, synthetic construct
GYYMH

SEQ ID NO: 386 - protein, 5 aa, synthetic construct
GYYMH

SEQ ID NO: 387 - protein, 5 aa, synthetic construct
AYYLH

SEQ ID NO: 388 - protein, 5 aa, synthetic construct
AYYLH

SEQ ID NO: 389 - protein, 5 aa, synthetic construct
AYYMH

SEQ ID NO: 390 - protein, 5 aa, synthetic construct
AYYMH

SEQ ID NO: 391 - protein, 5 aa, synthetic construct
GYYMH

SEQ ID NO: 392 - protein, 5 aa, synthetic construct
GYYMH

SEQ ID NO: 393 - protein, 5 aa, synthetic construct
AYYLH

SEQ ID NO: 394 - protein, 5 aa, synthetic construct
AYYLH

SEQ ID NO: 395 - protein, 5 aa, synthetic construct
GYYMH

SEQ ID NO: 396 - protein, 5 aa, synthetic construct
GYYMH

SEQ ID NO: 397 - protein, 5 aa, synthetic construct
GYYIH

SEQ ID NO: 398 - protein, 5 aa, synthetic construct
GYYMH

SEQ ID NO: 399 - protein, 5 aa, synthetic construct
AYYIH

SEQ ID NO: 400 - protein, 5 aa, synthetic construct
GYFMH

SEQ ID NO: 401 - protein, 5 aa, synthetic construct
GYYMH

SEQ ID NO: 402 - protein, 5 aa, synthetic construct
GYYMH

SEQ ID NO: 403 - protein, 5 aa, synthetic construct
GYYMH

SEQ ID NO: 404 - protein, 5 aa, synthetic construct
GYYMH

SEQ ID NO: 405 - protein, 5 aa, synthetic construct
GYYMH

SEQ ID NO: 406 - protein, 5 aa, synthetic construct
AYYMH

SEQ ID NO: 407 - protein, 5 aa, synthetic construct
AYYIH

SEQ ID NO: 408 - protein, 5 aa, synthetic construct
GYYIH

SEQ ID NO: 409 - protein, 5 aa, synthetic construct
GYYMH

SEQ ID NO: 410 - protein, 5 aa, synthetic construct
GYYMH

SEQ ID NO: 411 - protein, 5 aa, synthetic construct
AYYIH

SEQ ID NO: 412 - protein, 5 aa, synthetic construct
GYYMH

SEQ ID NO: 413 - protein, 5 aa, synthetic construct
AYYIH

SEQ ID NO: 414 - protein, 5 aa, synthetic construct
GYYMH

SEQ ID NO: 415 - protein, 5 aa, synthetic construct
GYYMH

SEQ ID NO: 416 - protein, 5 aa, synthetic construct
GYYMH

SEQ ID NO: 417 - protein, 5 aa, synthetic construct
RYGMN

SEQ ID NO: 418 - protein, 5 aa, synthetic construct
GYYMH

SEQ ID NO: 419 - protein, 5 aa, synthetic construct
VYYMH

SEQ ID NO: 420 - protein, 5 aa, synthetic construct
RYGMN

SEQ ID NO: 421 - protein, 5 aa, synthetic construct
TYGMN

SEQ ID NO: 422 - protein, 17 aa, synthetic construct
WINPKSGGTIYAQKFQG

SEQ ID NO: 423 - protein, 16 aa, synthetic construct
EITHSGITNYNPSLES

SEQ ID NO: 424 - protein, 17 aa, synthetic construct
WINPNSGGTNYAQNFQG

SEQ ID NO: 425 - protein, 17 aa, synthetic construct
WINPKSGGTNYAQNFQG

SEQ ID NO: 426 - protein, 17 aa, synthetic construct
WINPNSGGTNYAQKFQG

SEQ ID NO: 427 - protein, 17 aa, synthetic construct
WINPNSGGTNYAQSFQG

SEQ ID NO: 428 - protein, 17 aa, synthetic construct
WINPKSGGTNYAQSFQG

SEQ ID NO: 429 - protein, 17 aa, synthetic construct
WINPNSGGTNYAQQFQG

SEQ ID NO: 430 - protein, 17 aa, synthetic construct
WINPKSGGTNYAQQFQG

SEQ ID NO: 431 - protein, 17 aa, synthetic construct
WINPNSGGTNYAQKFQG

SEQ ID NO: 432 - protein, 17 aa, synthetic construct
WINPKSGGTNYAQKFQG

SEQ ID NO: 433 - protein, 17 aa, synthetic construct
WINPNSGGTNFAQKFQG

SEQ ID NO: 434 - protein, 17 aa, synthetic construct
WINPKSGGTNFAQKFQG

SEQ ID NO: 435 - protein, 17 aa, synthetic construct
WINPNSGGTNYAQKFQG

SEQ ID NO: 436 - protein, 17 aa, synthetic construct
WINPKSGGTNYAQKFQG

SEQ ID NO: 437 - protein, 17 aa, synthetic construct
WINPNSGGTNYAQRFQG

SEQ ID NO: 438 - protein, 17 aa, synthetic construct
WINPKSGGTNYAQRFQG

SEQ ID NO: 439 - protein, 17 aa, synthetic construct
WINPKSGGTIYAQKFQG

SEQ ID NO: 440 - protein, 17 aa, synthetic construct
WINPKSGGTNYAQKFQG

SEQ ID NO: 441 - protein, 17 aa, synthetic construct
WINPKSGGTSYAQKFQG

SEQ ID NO: 442 - protein, 17 aa, synthetic construct
WINPKSGGTNYAQKFQG

SEQ ID NO: 443 - protein, 17 aa, synthetic construct
WINPNSGGTNYAQNFQG

SEQ ID NO: 444 - protein, 17 aa, synthetic construct
WINPKSGGTNYAQNFQG

SEQ ID NO: 445 - protein, 17 aa, synthetic construct
WINPKSGGTNYAQNFQG

SEQ ID NO: 446 - protein, 17 aa, synthetic construct
WINPNSGGTNYAQKFQG

SEQ ID NO: 447 - protein, 17 aa, synthetic construct
WINPKSGGTNYAQKFQG

SEQ ID NO: 448 - protein, 17 aa, synthetic construct
WINPNSGGTKYAQKFQG

SEQ ID NO: 449 - protein, 17 aa, synthetic construct
WINPKSGGTKYAQKFQG

SEQ ID NO: 450 - protein, 17 aa, synthetic construct
WINPNSGGTNYAQKFQG

SEQ ID NO: 451 - protein, 17 aa, synthetic construct
WINPKSGGTNYAQKFQG

SEQ ID NO: 452 - protein, 17 aa, synthetic construct
WINPKSGGTNYAQKFQD

SEQ ID NO: 453 - protein, 17 aa, synthetic construct
WINPNSGGTKYAQKFQG

SEQ ID NO: 454 - protein, 17 aa, synthetic construct
WINPKSGGTKYAQKFQG

SEQ ID NO: 455 - protein, 17 aa, synthetic construct
WINPNSGGTSSAQKFQG

SEQ ID NO: 456 - protein, 17 aa, synthetic construct
WINPKSGGTSSAQKFQG

SEQ ID NO: 457 - protein, 17 aa, synthetic construct
WVNPNSGGTNYAQSFQG

SEQ ID NO: 458 - protein, 17 aa, synthetic construct
WVNPKSGGTNYAQSFQG

SEQ ID NO: 459 - protein, 17 aa, synthetic construct
WINPNSGGTKYAQKFQG

SEQ ID NO: 460 - protein, 17 aa, synthetic construct
WINPKSGGTKYAQKFQG

SEQ ID NO: 461 - protein, 17 aa, synthetic construct
WINPKSGGTNYAQKFQG

SEQ ID NO: 462 - protein, 17 aa, synthetic construct
WINPNSGGTNYAQKFQG

SEQ ID NO: 463 - protein, 17 aa, synthetic construct
WINPKSGGTNYAQKFQG

SEQ ID NO: 464 - protein, 17 aa, synthetic construct
WIHPNSGGTNSAQKFQG

SEQ ID NO: 465 - protein, 17 aa, synthetic construct
WIHPKSGGTNTAQKFQG

SEQ ID NO: 466 - protein, 17 aa, synthetic construct
WINPKSGGTNYAQKFQG

SEQ ID NO: 467 - protein, 17 aa, synthetic construct
WINPNSGGTNYAQKFQG

SEQ ID NO: 468 - protein, 17 aa, synthetic construct
WINPKSGGTNYAQKFQG

SEQ ID NO: 469 - protein, 17 aa, synthetic construct
WINPNSGGPNYAQKFQD

SEQ ID NO: 470 - protein, 17 aa, synthetic construct
WINPKSGGPNYAQKFQD

SEQ ID NO: 471 - protein, 17 aa, synthetic construct
WINPNSGGTNYAQRFQG

SEQ ID NO: 472 - protein, 17 aa, synthetic construct
WINPKSGGTNYAQRFQG

SEQ ID NO: 473 - protein, 17 aa, synthetic construct
WINPNSGGTNYAQKFQG

SEQ ID NO: 474 - protein, 17 aa, synthetic construct
WINPKSGGTNYAQKFQG

SEQ ID NO: 475 - protein, 17 aa, synthetic construct
WINPNSGGTIYAQKFQG

SEQ ID NO: 476 - protein, 17 aa, synthetic construct
WINPKSGGTIYAQKFQG

SEQ ID NO: 477 - protein, 17 aa, synthetic construct
WIKPNSGGTNYAQKFQG

SEQ ID NO: 478 - protein, 17 aa, synthetic construct
WIKPKSGGTNYAQKFQG

SEQ ID NO: 479 - protein, 17 aa, synthetic construct
WVNPNSGGTNYAQNFQG

SEQ ID NO: 480 - protein, 17 aa, synthetic construct
WVNPKSGGTNYAQNFQG

SEQ ID NO: 481 - protein, 17 aa, synthetic construct
WINPNSGGTNYAQKFQG

SEQ ID NO: 482 - protein, 17 aa, synthetic construct
WINPKSGGTNYAQKFQG

SEQ ID NO: 483 - protein, 17 aa, synthetic construct
WINPNSGGTNYAQRFQG

SEQ ID NO: 484 - protein, 17 aa, synthetic construct
WINPKSGGTNYAQRFQG

SEQ ID NO: 485 - protein, 17 aa, synthetic construct
WIKPNSGGTNYAQKFQG

SEQ ID NO: 486 - protein, 17 aa, synthetic construct
WIKPKSGGTNYAQKFQG

SEQ ID NO: 487 - protein, 17 aa, synthetic construct
WINPNSGGTNYAQKFQG

SEQ ID NO: 488 - protein, 17 aa, synthetic construct
WINPKSGGTNYAQKFQG

SEQ ID NO: 489 - protein, 17 aa, synthetic construct
WINPNSGGTKYAQKFQG

SEQ ID NO: 490 - protein, 17 aa, synthetic construct
WINPKSGGTKYAQKFQG

SEQ ID NO: 491 - protein, 17 aa, synthetic construct
WINPNSGGTNYAQKFQG

SEQ ID NO: 492 - protein, 17 aa, synthetic construct
WINPNSGGTNYAQKFQG

SEQ ID NO: 493 - protein, 17 aa, synthetic construct
WINPKSGGTNYAQKFQG

SEQ ID NO: 494 - protein, 17 aa, synthetic construct
WINPNSGATNFAQKFQG

SEQ ID NO: 495 - protein, 17 aa, synthetic construct
WINPKSGATNFAQKFQG

SEQ ID NO: 496 - protein, 17 aa, synthetic construct
WINPNSGGTNYAQKFQD

SEQ ID NO: 497 - protein, 17 aa, synthetic construct
WINPKSGGTNYAQKFQD

SEQ ID NO: 498 - protein, 17 aa, synthetic construct
WINPNSGGTKYAQKFQG

SEQ ID NO: 499 - protein, 17 aa, synthetic construct
WINPKSGGTKYAQKFQG

SEQ ID NO: 500 - protein, 17 aa, synthetic construct
WINPKSGGTNYAQKFQG

SEQ ID NO: 501 - protein, 17 aa, synthetic construct
WINPKSGGTNYAQKFQG

SEQ ID NO: 502 - protein, 17 aa, synthetic construct
WINPNSGGTSSAQKFQG

SEQ ID NO: 503 - protein, 17 aa, synthetic construct
WINPKSGGTSSAQKFQG

SEQ ID NO: 504 - protein, 17 aa, synthetic construct
WINPNSGGTHYAQKFQG

SEQ ID NO: 505 - protein, 17 aa, synthetic construct
WINPKSGGTHYAQKFQG

SEQ ID NO: 506 - protein, 17 aa, synthetic construct
WINPNSGGTNYAQRFQG

SEQ ID NO: 507 - protein, 17 aa, synthetic construct
WINPKSGGTIYAQKFQG

SEQ ID NO: 508 - protein, 17 aa, synthetic construct
WINPNSGGTNYAQKFQG

SEQ ID NO: 509 - protein, 17 aa, synthetic construct
WINPKSGGTNYAQKFQG

SEQ ID NO: 510 - protein, 17 aa, synthetic construct
WINPNSGGTKYAQKFQG

SEQ ID NO: 511 - protein, 17 aa, synthetic construct
WINPNSGGTNYAQKFQG

SEQ ID NO: 512 - protein, 17 aa, synthetic construct
WINPNSGGTNYAQKFQG

SEQ ID NO: 513 - protein, 17 aa, synthetic construct
WINPNSGGTKYSQKFQG

SEQ ID NO: 514 - protein, 17 aa, synthetic construct
WINPNSGGTNYAQKFQG

SEQ ID NO: 515 - protein, 17 aa, synthetic construct
WINPNSGGTNYAQKFQG

SEQ ID NO: 516 - protein, 17 aa, synthetic construct
WINPNSGGTNYAQKFQD

SEQ ID NO: 517 - protein, 17 aa, synthetic construct
WINPNSGGTKYAQKFHG

SEQ ID NO: 518 - protein, 17 aa, synthetic construct
WINPNSGGTNYAQKFQG

SEQ ID NO: 519 - protein, 17 aa, synthetic construct
WINPNSGGTNYAQKFQG

SEQ ID NO: 520 - protein, 17 aa, synthetic construct
WINPNSGGTNYAQRFQG

SEQ ID NO: 521 - protein, 17 aa, synthetic construct
WINPKSGGTNYAQKFQG

SEQ ID NO: 522 - protein, 17 aa, synthetic construct
WINPNSGGTSSAQKFQG

SEQ ID NO: 523 - protein, 17 aa, synthetic construct
WINPNSGGTNYAQKFQG

SEQ ID NO: 524 - protein, 17 aa, synthetic construct
WINPNSGGTKYAQKFQG

SEQ ID NO: 525 - protein, 17 aa, synthetic construct
WINPKSGGTNYAQKFQG

SEQ ID NO: 526 - protein, 17 aa, synthetic construct
WINTNTGNPTYAQDFTG

SEQ ID NO: 527 - protein, 17 aa, synthetic construct
WINPKSGGTIYAQKFQG

SEQ ID NO: 528 - protein, 17 aa, synthetic construct
WINPNSGGTNYAQKFQG

SEQ ID NO: 529 - protein, 17 aa, synthetic construct
WINTNTGNPTYAQGFTG

SEQ ID NO: 530 - protein, 17 aa, synthetic construct
WINTNTGNPTYAQGFTG

SEQ ID NO: 531 - protein, 9 aa, synthetic construct
GGSFDAFDI

SEQ ID NO: 532 - protein, 15 aa, synthetic construct
GQVGTTDYYYFYMDV

SEQ ID NO: 533 - protein, 9 aa, synthetic construct
GGSFDAFDI

SEQ ID NO: 534 - protein, 9 aa, synthetic construct
GGSFDAFDI

SEQ ID NO: 535 - protein, 9 aa, synthetic construct
GGSFDAFDI

SEQ ID NO: 536 - protein, 9 aa, synthetic construct
GGSFDAFDI

SEQ ID NO: 537 - protein, 9 aa, synthetic construct
GGSFDAFDI

SEQ ID NO: 538 - protein, 9 aa, synthetic construct
GGSYDAFDI

SEQ ID NO: 539 - protein, 9 aa, synthetic construct
GGSYDAFDI

SEQ ID NO: 540 - protein, 9 aa, synthetic construct
GGSFDAFDI

SEQ ID NO: 541 - protein, 9 aa, synthetic construct
GGSFDAFDI

SEQ ID NO: 542 - protein, 9 aa, synthetic construct
GGSYDAFDI

SEQ ID NO: 543 - protein, 9 aa, synthetic construct
GGSYDAFDI

SEQ ID NO: 544 - protein, 9 aa, synthetic construct
GGSYDAFDI

SEQ ID NO: 545 - protein, 9 aa, synthetic construct
GGSYDAFDI

SEQ ID NO: 546 - protein, 9 aa, synthetic construct
GGSFDAFDI

SEQ ID NO: 547 - protein, 9 aa, synthetic construct
GGSFDAFDI

SEQ ID NO: 548 - protein, 9 aa, synthetic construct
GGSFDAFDI

SEQ ID NO: 549 - protein, 9 aa, synthetic construct
GGSFDAFDI

SEQ ID NO: 550 - protein, 9 aa, synthetic construct
GGSYDAFDI

SEQ ID NO: 551 - protein, 9 aa, synthetic construct
GGSYDAFDI

SEQ ID NO: 552 - protein, 9 aa, synthetic construct
GGSFDAFDI

SEQ ID NO: 553 - protein, 9 aa, synthetic construct
GGSFDAFDI

SEQ ID NO: 554 - protein, 9 aa, synthetic construct
GGSFDAFDI

SEQ ID NO: 555 - protein, 9 aa, synthetic construct
GGSYDAFDI

SEQ ID NO: 556 - protein, 9 aa, synthetic construct
GGSYDAFDI

SEQ ID NO: 557 - protein, 9 aa, synthetic construct
GGSYDAFDI

SEQ ID NO: 558 - protein, 9 aa, synthetic construct
GGSYDAFDI

SEQ ID NO: 559 - protein, 9 aa, synthetic construct
GGSFDAFDI

SEQ ID NO: 560 - protein, 9 aa, synthetic construct
GGSFDAFDI

SEQ ID NO: 561 - protein, 9 aa, synthetic construct
GGSYDAFDI

SEQ ID NO: 562 - protein, 9 aa, synthetic construct
GGSYDAFDI

SEQ ID NO: 563 - protein, 9 aa, synthetic construct
GGSYDAFDI

SEQ ID NO: 564 - protein, 9 aa, synthetic construct
GGSFDAFDI

SEQ ID NO: 565 - protein, 9 aa, synthetic construct
GGSFDAFDI

SEQ ID NO: 566 - protein, 9 aa, synthetic construct
GGSFDAFDI

SEQ ID NO: 567 - protein, 9 aa, synthetic construct
GGSFDAFDI

SEQ ID NO: 568 - protein, 9 aa, synthetic construct
GGSFDAFDI

SEQ ID NO: 569 - protein, 9 aa, synthetic construct
GGSFDAFDI

SEQ ID NO: 570 - protein, 9 aa, synthetic construct
GGSYDAFDI

SEQ ID NO: 571 - protein, 9 aa, synthetic construct
GGSYDAFDI

SEQ ID NO: 572 - protein, 9 aa, synthetic construct
GGSYDAFDI

SEQ ID NO: 573 - protein, 9 aa, synthetic construct
GGSYDAFDI

SEQ ID NO: 574 - protein, 9 aa, synthetic construct
GGSYDAFDI

SEQ ID NO: 575 - protein, 9 aa, synthetic construct
GGSFDAFDI

SEQ ID NO: 576 - protein, 9 aa, synthetic construct
GGSFDAFDI

SEQ ID NO: 577 - protein, 9 aa, synthetic construct
GGSFDAFDI

SEQ ID NO: 578 - protein, 9 aa, synthetic construct
GGSFDAFDI

SEQ ID NO: 579 - protein, 9 aa, synthetic construct
GGSFDAFDI

SEQ ID NO: 580 - protein, 9 aa, synthetic construct
GGSFDAFDI

SEQ ID NO: 581 - protein, 9 aa, synthetic construct
GGSFDAFDI

SEQ ID NO: 582 - protein, 9 aa, synthetic construct
GGSFDAFDV

SEQ ID NO: 583 - protein, 9 aa, synthetic construct
GGSFDAFDV

SEQ ID NO: 584 - protein, 9 aa, synthetic construct
GGSFDAFDI

SEQ ID NO: 585 - protein, 9 aa, synthetic construct
GGSFDAFDI

SEQ ID NO: 586 - protein, 9 aa, synthetic construct
GGSYDAFDI

SEQ ID NO: 587 - protein, 9 aa, synthetic construct
GGSYDAFDI

SEQ ID NO: 588 - protein, 9 aa, synthetic construct
GGSFDAFDI

SEQ ID NO: 589 - protein, 9 aa, synthetic construct
GGSFDAFDI

SEQ ID NO: 590 - protein, 9 aa, synthetic construct
GGSFDAFDI

SEQ ID NO: 591 - protein, 9 aa, synthetic construct
GGSFDAFDI

SEQ ID NO: 592 - protein, 9 aa, synthetic construct
GGSFDAFDI

SEQ ID NO: 593 - protein, 9 aa, synthetic construct
GGSFDAFDI

SEQ ID NO: 594 - protein, 9 aa, synthetic construct
GGSYDAFDI

SEQ ID NO: 595 - protein, 9 aa, synthetic construct
GGSYDAFDI

SEQ ID NO: 596 - protein, 9 aa, synthetic construct
GGSFDAFDI

SEQ ID NO: 597 - protein, 9 aa, synthetic construct
GGSFDAFDI

SEQ ID NO: 598 - protein, 9 aa, synthetic construct
GGSYDAFDI

SEQ ID NO: 599 - protein, 9 aa, synthetic construct
GGSYDAFDI

SEQ ID NO: 600 - protein, 9 aa, synthetic construct
GGSFDAFDI

SEQ ID NO: 601 - protein, 9 aa, synthetic construct
GGSYDAFDI

SEQ ID NO: 602 - protein, 9 aa, synthetic construct
GGSYDAFDI

SEQ ID NO: 603 - protein, 9 aa, synthetic construct
GGSFDAFDI

SEQ ID NO: 604 - protein, 9 aa, synthetic construct
GGSFDAFDI

SEQ ID NO: 605 - protein, 9 aa, synthetic construct
GGSYDAFDI

SEQ ID NO: 606 - protein, 9 aa, synthetic construct
GGSYDAFDI

SEQ ID NO: 607 - protein, 9 aa, synthetic construct
GGSYDAFDI

SEQ ID NO: 608 - protein, 9 aa, synthetic construct
GGSYDAFDI

SEQ ID NO: 609 - protein, 9 aa, synthetic construct
GGSYDAFDI

SEQ ID NO: 610 - protein, 9 aa, synthetic construct
GGSYDAFDI

SEQ ID NO: 611 - protein, 9 aa, synthetic construct
GGSFDAFDI

SEQ ID NO: 612 - protein, 9 aa, synthetic construct
GGSFDAFDI

SEQ ID NO: 613 - protein, 9 aa, synthetic construct
GGSFDAFDI

SEQ ID NO: 614 - protein, 9 aa, synthetic construct
GGSFDAFDI

SEQ ID NO: 615 - protein, 9 aa, synthetic construct
GGSFDAFDI

SEQ ID NO: 616 - protein, 9 aa, synthetic construct
GGSFDAFDI

SEQ ID NO: 617 - protein, 9 aa, synthetic construct
GGSYDAFDI

SEQ ID NO: 618 - protein, 9 aa, synthetic construct
GGSFDAFDI

SEQ ID NO: 619 - protein, 9 aa, synthetic construct
GGSFDAFDI

SEQ ID NO: 620 - protein, 9 aa, synthetic construct
GGSFDAFDI

SEQ ID NO: 621 - protein, 9 aa, synthetic construct
GGSYDAFDI

SEQ ID NO: 622 - protein, 9 aa, synthetic construct
GGSFDAFDI

SEQ ID NO: 623 - protein, 9 aa, synthetic construct
GGSYDAFDI

SEQ ID NO: 624 - protein, 9 aa, synthetic construct
GGSIDAFDI

SEQ ID NO: 625 - protein, 9 aa, synthetic construct
GGSYDAFDI

SEQ ID NO: 626 - protein, 9 aa, synthetic construct
GGSFDAFDI

SEQ ID NO: 627 - protein, 9 aa, synthetic construct
GGSFDAFDV

SEQ ID NO: 628 - protein, 9 aa, synthetic construct
GGSFDAFDI

SEQ ID NO: 629 - protein, 9 aa, synthetic construct
GGSFDAFDI

SEQ ID NO: 630 - protein, 9 aa, synthetic construct
GGSFDAFDI

SEQ ID NO: 631 - protein, 9 aa, synthetic construct
GGSFDAFDI

SEQ ID NO: 632 - protein, 9 aa, synthetic construct
GGSYDAFDI

SEQ ID NO: 633 - protein, 9 aa, synthetic construct
GGSYDAFDI

SEQ ID NO: 634 - protein, 9 aa, synthetic construct
GGSFDAFDI

SEQ ID NO: 635 - protein, 9 aa, synthetic construct
DNWNYVSDY

SEQ ID NO: 636 - protein, 9 aa, synthetic construct
GGSFDAFDI

SEQ ID NO: 637 - protein, 9 aa, synthetic construct
GGSFDAFDI

SEQ ID NO: 638 - protein, 9 aa, synthetic construct
DNWNYDFDY

SEQ ID NO: 639 - protein, 9 aa, synthetic construct
DNWNYDLDY

SEQ ID NO: 640 - protein, 11 aa, synthetic construct
RASQSISRYLY

SEQ ID NO: 641 - protein, 11 aa, synthetic construct
RASQSIRRYLN

SEQ ID NO: 642 - protein, 11 aa, synthetic construct
RASQSISRYLN

SEQ ID NO: 643 - protein, 11 aa, synthetic construct
RASQSISRYLN

SEQ ID NO: 644 - protein, 11 aa, synthetic construct
RASQSISSYLN

SEQ ID NO: 645 - protein, 11 aa, synthetic construct
RASQSISRYLN

SEQ ID NO: 646 - protein, 11 aa, synthetic construct
RASQSISRYLN

SEQ ID NO: 647 - protein, 11 aa, synthetic construct
RASQSISSYLN

SEQ ID NO: 648 - protein, 11 aa, synthetic construct
RASQSISSYLN

SEQ ID NO: 649 - protein, 11 aa, synthetic construct
RASQSISSYLN

SEQ ID NO: 650 - protein, 11 aa, synthetic construct
RASQSISSYLN

SEQ ID NO: 651 - protein, 11 aa, synthetic construct
RASQSISSYLN

SEQ ID NO: 652 - protein, 11 aa, synthetic construct
RASQSISSYLN

SEQ ID NO: 653 - protein, 11 aa, synthetic construct
RASQSISSYLN

SEQ ID NO: 654 - protein, 11 aa, synthetic construct
RASQSISSYLN

SEQ ID NO: 655 - protein, 11 aa, synthetic construct
RASQSISSYLN

SEQ ID NO: 656 - protein, 11 aa, synthetic construct
RASQSISSYLN

SEQ ID NO: 657 - protein, 11 aa, synthetic construct
RASQSISSYLN

SEQ ID NO: 658 - protein, 11 aa, synthetic construct
RASQSISSYLN

SEQ ID NO: 659 - protein, 11 aa, synthetic construct
RASQSISSYLN

SEQ ID NO: 660 - protein, 11 aa, synthetic construct
RASQSISSYLN

SEQ ID NO: 661 - protein, 11 aa, synthetic construct
QASQDISNYLN

SEQ ID NO: 662 - protein, 11 aa, synthetic construct
QASQDISNYLN

SEQ ID NO: 663 - protein, 11 aa, synthetic construct
RASQGISRYLH

SEQ ID NO: 664 - protein, 11 aa, synthetic construct
RASQSISSYLN

SEQ ID NO: 665 - protein, 11 aa, synthetic construct
RASQSISSYLN

SEQ ID NO: 666 - protein, 11 aa, synthetic construct
RASQSISSYLN

SEQ ID NO: 667 - protein, 11 aa, synthetic construct
RASQSISSYLN

SEQ ID NO: 668 - protein, 11 aa, synthetic construct
RASQSISRYLN

SEQ ID NO: 669 - protein, 11 aa, synthetic construct
RASQSISRYLN

SEQ ID NO: 670 - protein, 11 aa, synthetic construct
RASQSISSYLN

SEQ ID NO: 671 - protein, 11 aa, synthetic construct
RASQSISSYLN

SEQ ID NO: 672 - protein, 11 aa, synthetic construct
RASQSISSYLN

SEQ ID NO: 673 - protein, 11 aa, synthetic construct
RASQSISSYLN

SEQ ID NO: 674 - protein, 11 aa, synthetic construct
RASQSISSYLN

SEQ ID NO: 675 - protein, 11 aa, synthetic construct
RASQSISSYLN

SEQ ID NO: 676 - protein, 11 aa, synthetic construct
RASQSISSYLN

SEQ ID NO: 677 - protein, 11 aa, synthetic construct
RASQSISSYLN

SEQ ID NO: 678 - protein, 11 aa, synthetic construct
RASQSISSYLN

SEQ ID NO: 679 - protein, 11 aa, synthetic construct
RASQSISSYLN

SEQ ID NO: 680 - protein, 11 aa, synthetic construct
RASQSISSYLN

SEQ ID NO: 681 - protein, 11 aa, synthetic construct
RASQSISSYLN

SEQ ID NO: 682 - protein, 11 aa, synthetic construct
RASQSISSYLN

SEQ ID NO: 683 - protein, 11 aa, synthetic construct
RASQSISSYLN

SEQ ID NO: 684 - protein, 11 aa, synthetic construct
RASQSISRYLN

SEQ ID NO: 685 - protein, 11 aa, synthetic construct
RASQSISSYLN

SEQ ID NO: 686 - protein, 11 aa, synthetic construct
RASQSISSYLN

SEQ ID NO: 687 - protein, 11 aa, synthetic construct
RASQSISNYLN

SEQ ID NO: 688 - protein, 11 aa, synthetic construct
RASQSISNYLN

SEQ ID NO: 689 - protein, 11 aa, synthetic construct
RASQSISSYLN

SEQ ID NO: 690 - protein, 11 aa, synthetic construct
RASQSISSYLN

SEQ ID NO: 691 - protein, 11 aa, synthetic construct
RASQSISSYLN

SEQ ID NO: 692 - protein, 11 aa, synthetic construct
RASQSISSYLN

SEQ ID NO: 693 - protein, 11 aa, synthetic construct
RASQSISSYLN

SEQ ID NO: 694 - protein, 11 aa, synthetic construct
RASQSISSYLN

SEQ ID NO: 695 - protein, 11 aa, synthetic construct
RASQSISSYLN

SEQ ID NO: 696 - protein, 11 aa, synthetic construct
RASQSISSYLN

SEQ ID NO: 697 - protein, 11 aa, synthetic construct
RASQSISSYLN

SEQ ID NO: 698 - protein, 11 aa, synthetic construct
RASQSISSYLN

SEQ ID NO: 699 - protein, 11 aa, synthetic construct
RASQTISSYLN

SEQ ID NO: 700 - protein, 11 aa, synthetic construct
RASQTISSYLN

SEQ ID NO: 701 - protein, 11 aa, synthetic construct
RASQSISKYLI

SEQ ID NO: 702 - protein, 11 aa, synthetic construct
RASQSISKYLI

SEQ ID NO: 703 - protein, 11 aa, synthetic construct
RASQSISSYLN

SEQ ID NO: 704 - protein, 11 aa, synthetic construct
RASQSISSYLN

SEQ ID NO: 705 - protein, 11 aa, synthetic construct
RASQSISSYLN

SEQ ID NO: 706 - protein, 11 aa, synthetic construct
RASQSISSYLN

SEQ ID NO: 707 - protein, 11 aa, synthetic construct
RASLSISSYLN

SEQ ID NO: 708 - protein, 11 aa, synthetic construct
RASLSISSYLN

SEQ ID NO: 709 - protein, 11 aa, synthetic construct
RASQSISSYLN

SEQ ID NO: 710 - protein, 11 aa, synthetic construct
RSSQSISSYLN

SEQ ID NO: 711 - protein, 11 aa, synthetic construct
RSSQSISSYLN

SEQ ID NO: 712 - protein, 11 aa, synthetic construct
RASRSISSYLN

SEQ ID NO: 713 - protein, 11 aa, synthetic construct
RASRSISSYLN

SEQ ID NO: 714 - protein, 11 aa, synthetic construct
RASQSINSYLN

SEQ ID NO: 715 - protein, 11 aa, synthetic construct
RASQSIQSYLN

SEQ ID NO: 716 - protein, 11 aa, synthetic construct
RASQSISSYLN

SEQ ID NO: 717 - protein, 11 aa, synthetic construct
RASQSISSYLN

SEQ ID NO: 718 - protein, 11 aa, synthetic construct
RASQSINSYLY

SEQ ID NO: 719 - protein, 11 aa, synthetic construct
RASQSIQSYLY

SEQ ID NO: 720 - protein, 11 aa, synthetic construct
RASQSISSYLN

SEQ ID NO: 721 - protein, 11 aa, synthetic construct
RASQSISSYLN

SEQ ID NO: 722 - protein, 11 aa, synthetic construct
RASLSISSYLN

SEQ ID NO: 723 - protein, 11 aa, synthetic construct
RASLSISSYLN

SEQ ID NO: 724 - protein, 11 aa, synthetic construct
RASQSISSYLN

SEQ ID NO: 725 - protein, 11 aa, synthetic construct
RASQTISRYLN

SEQ ID NO: 726 - protein, 11 aa, synthetic construct
RASQTISRYLN

SEQ ID NO: 727 - protein, 11 aa, synthetic construct
RASQSISSYLN

SEQ ID NO: 728 - protein, 11 aa, synthetic construct
RASQSISSYLN

SEQ ID NO: 729 - protein, 11 aa, synthetic construct
RASQSISRYLN

SEQ ID NO: 730 - protein, 11 aa, synthetic construct
RASQSISRYLN

SEQ ID NO: 731 - protein, 11 aa, synthetic construct
RASQSISSYLN

SEQ ID NO: 732 - protein, 11 aa, synthetic construct
RASQSISSYLN

SEQ ID NO: 733 - protein, 11 aa, synthetic construct
RASQSISSYLN

SEQ ID NO: 734 - protein, 11 aa, synthetic construct
RASQSISSYLN

SEQ ID NO: 735 - protein, 11 aa, synthetic construct
RASQSISRYLN

SEQ ID NO: 736 - protein, 11 aa, synthetic construct
RASQSISSYLN

SEQ ID NO: 737 - protein, 11 aa, synthetic construct
RASQSISSFLN

SEQ ID NO: 738 - protein, 11 aa, synthetic construct
RASQSISSYLN

SEQ ID NO: 739 - protein, 11 aa, synthetic construct
RASQSISSYLN

SEQ ID NO: 740 - protein, 11 aa, synthetic construct
RASQSISSYLN

SEQ ID NO: 741 - protein, 11 aa, synthetic construct
RASQSISSYLN

SEQ ID NO: 742 - protein, 11 aa, synthetic construct
RASQSISRYLY

SEQ ID NO: 743 - protein, 11 aa, synthetic construct
QASQDISNYLN

SEQ ID NO: 744 - protein, 12 aa, synthetic construct
RASQSVSDSYLA

SEQ ID NO: 745 - protein, 11 aa, synthetic construct
RASQSISSYLN

SEQ ID NO: 746 - protein, 11 aa, synthetic construct
RASQSISSYLN

SEQ ID NO: 747 - protein, 16 aa, synthetic construct
KSSQSLVHSDGNTYLS

SEQ ID NO: 748 - protein, 16 aa, synthetic construct
RSSQSLVHSDGNTYLS

SEQ ID NO: 749 - protein, 7 aa, synthetic construct
GASSLQS

SEQ ID NO: 750 - protein, 7 aa, synthetic construct
AASSLQS

SEQ ID NO: 751 - protein, 7 aa, synthetic construct
GASSVQS

SEQ ID NO: 752 - protein, 7 aa, synthetic construct
GASSVQS

SEQ ID NO: 753 - protein, 7 aa, synthetic construct
GASSLQS

SEQ ID NO: 754 - protein, 7 aa, synthetic construct
GASSVQS

SEQ ID NO: 755 - protein, 7 aa, synthetic construct
GASSVQS

SEQ ID NO: 756 - protein, 7 aa, synthetic construct
GASRLQS

SEQ ID NO: 757 - protein, 7 aa, synthetic construct
GASRLQS

SEQ ID NO: 758 - protein, 7 aa, synthetic construct
GASSLQS

SEQ ID NO: 759 - protein, 7 aa, synthetic construct
GASSLQS

SEQ ID NO: 760 - protein, 7 aa, synthetic construct
GASRLQS

SEQ ID NO: 761 - protein, 7 aa, synthetic construct
GASRLQS

SEQ ID NO: 762 - protein, 7 aa, synthetic construct
GASRLQS

SEQ ID NO: 763 - protein, 7 aa, synthetic construct
GASRLQS

SEQ ID NO: 764 - protein, 7 aa, synthetic construct
GASRLQS

SEQ ID NO: 765 - protein, 7 aa, synthetic construct
GASRLQS

SEQ ID NO: 766 - protein, 7 aa, synthetic construct
GASSLQS

SEQ ID NO: 767 - protein, 7 aa, synthetic construct
GASSLQS

SEQ ID NO: 768 - protein, 7 aa, synthetic construct
GASSLQS

SEQ ID NO: 769 - protein, 7 aa, synthetic construct
GASRLQS

SEQ ID NO: 770 - protein, 7 aa, synthetic construct
GASSLQS

SEQ ID NO: 771 - protein, 7 aa, synthetic construct
GASSLQS

SEQ ID NO: 772 - protein, 7 aa, synthetic construct
GASSLQS

SEQ ID NO: 773 - protein, 7 aa, synthetic construct
GASRLQS

SEQ ID NO: 774 - protein, 7 aa, synthetic construct
GASRLQS

SEQ ID NO: 775 - protein, 7 aa, synthetic construct
GASRLQS

SEQ ID NO: 776 - protein, 7 aa, synthetic construct
GASRLQS

SEQ ID NO: 777 - protein, 7 aa, synthetic construct
GASSVQS

SEQ ID NO: 778 - protein, 7 aa, synthetic construct
GASSVQS

SEQ ID NO: 779 - protein, 7 aa, synthetic construct
GASRLQS

SEQ ID NO: 780 - protein, 7 aa, synthetic construct
GASRLQS

SEQ ID NO: 781 - protein, 7 aa, synthetic construct
GASRLQS

SEQ ID NO: 782 - protein, 7 aa, synthetic construct
GASRLQS

SEQ ID NO: 783 - protein, 7 aa, synthetic construct
GASRLQS

SEQ ID NO: 784 - protein, 7 aa, synthetic construct
GASSLQS

SEQ ID NO: 785 - protein, 7 aa, synthetic construct
GASSLQS

SEQ ID NO: 786 - protein, 7 aa, synthetic construct
GASSLQS

SEQ ID NO: 787 - protein, 7 aa, synthetic construct
GASSLQS

SEQ ID NO: 788 - protein, 7 aa, synthetic construct
GASSLQS

SEQ ID NO: 789 - protein, 7 aa, synthetic construct
GASSLQS

SEQ ID NO: 790 - protein, 7 aa, synthetic construct
GASSLQS

SEQ ID NO: 791 - protein, 7 aa, synthetic construct
GASRLQS

SEQ ID NO: 792 - protein, 7 aa, synthetic construct
GASRLQS

SEQ ID NO: 793 - protein, 7 aa, synthetic construct
GASSVQS

SEQ ID NO: 794 - protein, 7 aa, synthetic construct
GASRLQS

SEQ ID NO: 795 - protein, 7 aa, synthetic construct
GASRLQS

SEQ ID NO: 796 - protein, 7 aa, synthetic construct
GTSRLQS

SEQ ID NO: 797 - protein, 7 aa, synthetic construct
GTSRLQS

SEQ ID NO: 798 - protein, 7 aa, synthetic construct
GASRLQS

SEQ ID NO: 799 - protein, 7 aa, synthetic construct
GASRLQS

SEQ ID NO: 800 - protein, 7 aa, synthetic construct
GASRLQS

SEQ ID NO: 801 - protein, 7 aa, synthetic construct
GASRLQS

SEQ ID NO: 802 - protein, 7 aa, synthetic construct
GASRLQS

SEQ ID NO: 803 - protein, 7 aa, synthetic construct
GASRLQS

SEQ ID NO: 804 - protein, 7 aa, synthetic construct
GASRLQS

SEQ ID NO: 805 - protein, 7 aa, synthetic construct
GASRLQS

SEQ ID NO: 806 - protein, 7 aa, synthetic construct
GASSLQS

SEQ ID NO: 807 - protein, 7 aa, synthetic construct
GASSLQS

SEQ ID NO: 808 - protein, 7 aa, synthetic construct
GASSLQS

SEQ ID NO: 809 - protein, 7 aa, synthetic construct
GASSLQS

SEQ ID NO: 810 - protein, 7 aa, synthetic construct
GASSLQS

SEQ ID NO: 811 - protein, 7 aa, synthetic construct
GASSLQS

SEQ ID NO: 812 - protein, 7 aa, synthetic construct
GASRLQS

SEQ ID NO: 813 - protein, 7 aa, synthetic construct
GASRLQS

SEQ ID NO: 814 - protein, 7 aa, synthetic construct
GASRLQS

SEQ ID NO: 815 - protein, 7 aa, synthetic construct
GASRLQS

SEQ ID NO: 816 - protein, 7 aa, synthetic construct
GASSLQS

SEQ ID NO: 817 - protein, 7 aa, synthetic construct
GASSLQS

SEQ ID NO: 818 - protein, 7 aa, synthetic construct
GASSLQS

SEQ ID NO: 819 - protein, 7 aa, synthetic construct
GASSLQS

SEQ ID NO: 820 - protein, 7 aa, synthetic construct
GASSLQS

SEQ ID NO: 821 - protein, 7 aa, synthetic construct
GASRLQT

SEQ ID NO: 822 - protein, 7 aa, synthetic construct
GASRLQT

SEQ ID NO: 823 - protein, 7 aa, synthetic construct
GASSLQS

SEQ ID NO: 824 - protein, 7 aa, synthetic construct
GASSLQS

SEQ ID NO: 825 - protein, 7 aa, synthetic construct
GASRLQS

SEQ ID NO: 826 - protein, 7 aa, synthetic construct
GASRLQS

SEQ ID NO: 827 - protein, 7 aa, synthetic construct
GASSLQS

SEQ ID NO: 828 - protein, 7 aa, synthetic construct
GASSLQS

SEQ ID NO: 829 - protein, 7 aa, synthetic construct
GASSLQS

SEQ ID NO: 830 - protein, 7 aa, synthetic construct
GASSLQS

SEQ ID NO: 831 - protein, 7 aa, synthetic construct
GASSLQS

SEQ ID NO: 832 - protein, 7 aa, synthetic construct
GASSLQS

SEQ ID NO: 833 - protein, 7 aa, synthetic construct
GASRLQS

SEQ ID NO: 834 - protein, 7 aa, synthetic construct
GASSLQS

SEQ ID NO: 835 - protein, 7 aa, synthetic construct
GASSLQS

SEQ ID NO: 836 - protein, 7 aa, synthetic construct
GASRLQS

SEQ ID NO: 837 - protein, 7 aa, synthetic construct
GASRLQS

SEQ ID NO: 838 - protein, 7 aa, synthetic construct
GASSVQS

SEQ ID NO: 839 - protein, 7 aa, synthetic construct
GASSLQS

SEQ ID NO: 840 - protein, 7 aa, synthetic construct
GASRLQS

SEQ ID NO: 841 - protein, 7 aa, synthetic construct
GASRLQS

SEQ ID NO: 842 - protein, 7 aa, synthetic construct
GASRLQS

SEQ ID NO: 843 - protein, 7 aa, synthetic construct
GASRLQS

SEQ ID NO: 844 - protein, 7 aa, synthetic construct
GASRLQS

SEQ ID NO: 845 - protein, 7 aa, synthetic construct
GASSLQS

SEQ ID NO: 846 - protein, 7 aa, synthetic construct
GASRLQS

SEQ ID NO: 847 - protein, 7 aa, synthetic construct
GASSLQS

SEQ ID NO: 848 - protein, 7 aa, synthetic construct
GASSLQS

SEQ ID NO: 849 - protein, 7 aa, synthetic construct
GASRLQS

SEQ ID NO: 850 - protein, 7 aa, synthetic construct
GASRLQS

SEQ ID NO: 851 - protein, 7 aa, synthetic construct
AASSLQS

SEQ ID NO: 852 - protein, 7 aa, synthetic construct
AASSLQT

SEQ ID NO: 853 - protein, 7 aa, synthetic construct
GASSRAT

SEQ ID NO: 854 - protein, 7 aa, synthetic construct
GASSLQS

SEQ ID NO: 855 - protein, 7 aa, synthetic construct
GASRLQS

SEQ ID NO: 856 - protein, 7 aa, synthetic construct
KISNRFS

SEQ ID NO: 857 - protein, 7 aa, synthetic construct
KISNRFS

SEQ ID NO: 858 - protein, 9 aa, synthetic construct
QQGFSAPLT

SEQ ID NO: 859 - protein, 8 aa, synthetic construct
QQSYRTIT

SEQ ID NO: 860 - protein, 9 aa, synthetic construct
QQGDSSPFT

SEQ ID NO: 861 - protein, 9 aa, synthetic construct
QQGDSSPFT

SEQ ID NO: 862 - protein, 9 aa, synthetic construct
QQGHSTPFT

SEQ ID NO: 863 - protein, 9 aa, synthetic construct
QQGDSSPFT

SEQ ID NO: 864 - protein, 9 aa, synthetic construct
QQGDSSPFT

SEQ ID NO: 865 - protein, 9 aa, synthetic construct
QQGHSTPFT

SEQ ID NO: 866 - protein, 9 aa, synthetic construct
QQGHSTPFT

SEQ ID NO: 867 - protein, 9 aa, synthetic construct
QQGDSTPFT

SEQ ID NO: 868 - protein, 9 aa, synthetic construct
QQGDSTPFT

SEQ ID NO: 869 - protein, 9 aa, synthetic construct
QQGDSTPFT

SEQ ID NO: 870 - protein, 9 aa, synthetic construct
QQGDSTPFT

SEQ ID NO: 871 - protein, 9 aa, synthetic construct
QQGDSTPFT

SEQ ID NO: 872 - protein, 9 aa, synthetic construct
QQGDSTPFT

SEQ ID NO: 873 - protein, 9 aa, synthetic construct
QQGDSSPFT

SEQ ID NO: 874 - protein, 9 aa, synthetic construct
QQGDSSPFT

SEQ ID NO: 875 - protein, 9 aa, synthetic construct
QQGHSTPFT

SEQ ID NO: 876 - protein, 9 aa, synthetic construct
QQGDSTPFT

SEQ ID NO: 877 - protein, 9 aa, synthetic construct
QQGHSTPFT

SEQ ID NO: 878 - protein, 9 aa, synthetic construct
QQGYSSPFT

SEQ ID NO: 879 - protein, 9 aa, synthetic construct
QQGDSTPFT

SEQ ID NO: 880 - protein, 9 aa, synthetic construct
QQGDSTPFT

SEQ ID NO: 881 - protein, 9 aa, synthetic construct
QQGFSTPFT

SEQ ID NO: 882 - protein, 9 aa, synthetic construct
QQGSSPPFT

SEQ ID NO: 883 - protein, 9 aa, synthetic construct
QQGSSPPFT

SEQ ID NO: 884 - protein, 9 aa, synthetic construct
QQGYSSPFT

SEQ ID NO: 885 - protein, 9 aa, synthetic construct
QQGYSSPFT

SEQ ID NO: 886 - protein, 9 aa, synthetic construct
QQGDSSPFT

SEQ ID NO: 887 - protein, 9 aa, synthetic construct
QQGDSSPFT

SEQ ID NO: 888 - protein, 9 aa, synthetic construct
QQGHSTPFT

SEQ ID NO: 889 - protein, 9 aa, synthetic construct
QQGDSTPFT

SEQ ID NO: 890 - protein, 9 aa, synthetic construct
QQGDSTPFT

SEQ ID NO: 891 - protein, 9 aa, synthetic construct
QQGYSSPFT

SEQ ID NO: 892 - protein, 9 aa, synthetic construct
QQGYSSPFT

SEQ ID NO: 893 - protein, 9 aa, synthetic construct
QQGHSTPFT

SEQ ID NO: 894 - protein, 9 aa, synthetic construct
QQGHSTPFT

SEQ ID NO: 895 - protein, 9 aa, synthetic construct
QQGDSTPFT

SEQ ID NO: 896 - protein, 9 aa, synthetic construct
QQGDSTPFT

SEQ ID NO: 897 - protein, 9 aa, synthetic construct
QQGDSTPFT

SEQ ID NO: 898 - protein, 9 aa, synthetic construct
QQGDSTPFT

SEQ ID NO: 899 - protein, 9 aa, synthetic construct
QQGDSTPFT

SEQ ID NO: 900 - protein, 9 aa, synthetic construct
QQGYSSPFT

SEQ ID NO: 901 - protein, 9 aa, synthetic construct
QQGYSSPFT

SEQ ID NO: 902 - protein, 9 aa, synthetic construct
QQGDSSPFT

SEQ ID NO: 903 - protein, 9 aa, synthetic construct
QQGYSSPFT

SEQ ID NO: 904 - protein, 9 aa, synthetic construct
QQGYSSPFT

SEQ ID NO: 905 - protein, 9 aa, synthetic construct
QQGYSSPFT

SEQ ID NO: 906 - protein, 9 aa, synthetic construct
QQGYSSPFT

SEQ ID NO: 907 - protein, 9 aa, synthetic construct
QQGYSSPFT

SEQ ID NO: 908 - protein, 9 aa, synthetic construct
QQGYSSPFT

SEQ ID NO: 909 - protein, 9 aa, synthetic construct
QQGDNTPFT

SEQ ID NO: 910 - protein, 9 aa, synthetic construct
QQGDNTPFT

SEQ ID NO: 911 - protein, 9 aa, synthetic construct
QQGHSTPFT

SEQ ID NO: 912 - protein, 9 aa, synthetic construct
QQGHSTPFT

SEQ ID NO: 913 - protein, 9 aa, synthetic construct
QQGYSSPFT

SEQ ID NO: 914 - protein, 9 aa, synthetic construct
QQGYSSPFT

SEQ ID NO: 915 - protein, 9 aa, synthetic construct
QQGHSTPFT

SEQ ID NO: 916 - protein, 9 aa, synthetic construct
QQGHSTPFT

SEQ ID NO: 917 - protein, 9 aa, synthetic construct
QQGDSTPFT

SEQ ID NO: 918 - protein, 9 aa, synthetic construct
QQGDSTPFT

SEQ ID NO: 919 - protein, 9 aa, synthetic construct
QQGHSTPFT

SEQ ID NO: 920 - protein, 9 aa, synthetic construct
QQGHSTPFT

SEQ ID NO: 921 - protein, 9 aa, synthetic construct
QQGDSTPFT

SEQ ID NO: 922 - protein, 9 aa, synthetic construct
QQGDSTPFT

SEQ ID NO: 923 - protein, 9 aa, synthetic construct
QQGYSSPFT

SEQ ID NO: 924 - protein, 9 aa, synthetic construct
QQGYSSPFT

SEQ ID NO: 925 - protein, 9 aa, synthetic construct
QQGHSTPFT

SEQ ID NO: 926 - protein, 9 aa, synthetic construct
QQGHSTPFT

SEQ ID NO: 927 - protein, 9 aa, synthetic construct
QQGDSTPFT

SEQ ID NO: 928 - protein, 9 aa, synthetic construct
QQGDSTPFT

SEQ ID NO: 929 - protein, 9 aa, synthetic construct
QQGDSTPFT

SEQ ID NO: 930 - protein, 9 aa, synthetic construct
QQGYSSPFT

SEQ ID NO: 931 - protein, 9 aa, synthetic construct
QQGYSSPFT

SEQ ID NO: 932 - protein, 9 aa, synthetic construct
QQGYSTPFT

SEQ ID NO: 933 - protein, 9 aa, synthetic construct
QQGYSTPFT

SEQ ID NO: 934 - protein, 9 aa, synthetic construct
QQGDNTPFT

SEQ ID NO: 935 - protein, 9 aa, synthetic construct
QQGDNTPFT

SEQ ID NO: 936 - protein, 9 aa, synthetic construct
QQGYSTPFT

SEQ ID NO: 937 - protein, 9 aa, synthetic construct
QQGYSTPFT

SEQ ID NO: 938 - protein, 9 aa, synthetic construct
QQGDSTPFT

SEQ ID NO: 939 - protein, 9 aa, synthetic construct
QQGDSTPFT

SEQ ID NO: 940 - protein, 9 aa, synthetic construct
QQGHSTPFT

SEQ ID NO: 941 - protein, 9 aa, synthetic construct
QQGHSTPFT

SEQ ID NO: 942 - protein, 9 aa, synthetic construct
QQGYSSPFT

SEQ ID NO: 943 - protein, 9 aa, synthetic construct
QQSYSTPFT

SEQ ID NO: 944 - protein, 9 aa, synthetic construct
QQGYSTPFT

SEQ ID NO: 945 - protein, 9 aa, synthetic construct
QQGDSTPFT

SEQ ID NO: 946 - protein, 9 aa, synthetic construct
QQGYSSPFT

SEQ ID NO: 947 - protein, 9 aa, synthetic construct
QQGDSSPFT

SEQ ID NO: 948 - protein, 9 aa, synthetic construct
QQGYSTLFT

SEQ ID NO: 949 - protein, 9 aa, synthetic construct
QQGYSSPFT

SEQ ID NO: 950 - protein, 9 aa, synthetic construct
QQGYSNPFT

SEQ ID NO: 951 - protein, 9 aa, synthetic construct
QQGFSTPFT

SEQ ID NO: 952 - protein, 9 aa, synthetic construct
QQGYSSPFT

SEQ ID NO: 953 - protein, 9 aa, synthetic construct
QQGYSSPFT

SEQ ID NO: 954 - protein, 9 aa, synthetic construct
QQGDSTPFT

SEQ ID NO: 955 - protein, 9 aa, synthetic construct
QQGDSTPFT

SEQ ID NO: 956 - protein, 9 aa, synthetic construct
QQGHSTPFT

SEQ ID NO: 957 - protein, 9 aa, synthetic construct
QQGHSTPFT

SEQ ID NO: 958 - protein, 9 aa, synthetic construct
QQGHSTPIT

SEQ ID NO: 959 - protein, 9 aa, synthetic construct
QQGYSSPFT

SEQ ID NO: 960 - protein, 9 aa, synthetic construct
QQGYDTPFT

SEQ ID NO: 961 - protein, 9 aa, synthetic construct
QQGDSTPFT

SEQ ID NO: 962 - protein, 9 aa, synthetic construct
QQYGTSPIT

SEQ ID NO: 963 - protein, 9 aa, synthetic construct
QQAKSFPLT

SEQ ID NO: 964 - protein, 9 aa, synthetic construct
QQGYSSPFT

SEQ ID NO: 965 - protein, 9 aa, synthetic construct
MQVTQFPIT

SEQ ID NO: 966 - protein, 9 aa, synthetic construct
MQATQFPIT

SEQ ID NO: 967 - protein, 7 aa, synthetic construct
GYTFTGY

SEQ ID NO: 968 - protein, 7 aa, synthetic construct
GGSFSGY

SEQ ID NO: 969 - protein, 7 aa, synthetic construct
GYTFTGY

SEQ ID NO: 970 - protein, 7 aa, synthetic construct
GYTFTGY

SEQ ID NO: 971 - protein, 7 aa, synthetic construct
GYTFTGY

SEQ ID NO: 972 - protein, 7 aa, synthetic construct
GYTFTAY

SEQ ID NO: 973 - protein, 7 aa, synthetic construct
GYTFTAY

SEQ ID NO: 974 - protein, 7 aa, synthetic construct
GYTFTAY

SEQ ID NO: 975 - protein, 7 aa, synthetic construct
GYTFTAY

SEQ ID NO: 976 - protein, 7 aa, synthetic construct
GYTFTAY

SEQ ID NO: 977 - protein, 7 aa, synthetic construct
GYTFTAY

SEQ ID NO: 978 - protein, 7 aa, synthetic construct
GYTFTGY

SEQ ID NO: 979 - protein, 7 aa, synthetic construct
GYTFTGY

SEQ ID NO: 980 - protein, 7 aa, synthetic construct
GYTFTGY

SEQ ID NO: 981 - protein, 7 aa, synthetic construct
GYTFTGY

SEQ ID NO: 982 - protein, 7 aa, synthetic construct
GYTFTGY

SEQ ID NO: 983 - protein, 7 aa, synthetic construct
GYTFTGY

SEQ ID NO: 984 - protein, 7 aa, synthetic construct
GYTFTGY

SEQ ID NO: 985 - protein, 7 aa, synthetic construct
GYTFTGY

SEQ ID NO: 986 - protein, 7 aa, synthetic construct
GYTFTGY

SEQ ID NO: 987 - protein, 7 aa, synthetic construct
GYTFTGY

SEQ ID NO: 988 - protein, 7 aa, synthetic construct
GYTFTAY

SEQ ID NO: 989 - protein, 7 aa, synthetic construct
GYTFTAY

SEQ ID NO: 990 - protein, 7 aa, synthetic construct
GYTFTGY

SEQ ID NO: 991 - protein, 7 aa, synthetic construct
GYTFTGY

SEQ ID NO: 992 - protein, 7 aa, synthetic construct
GYTFTGY

SEQ ID NO: 993 - protein, 7 aa, synthetic construct
GYTFTAY

SEQ ID NO: 994 - protein, 7 aa, synthetic construct
GYTFTAY

SEQ ID NO: 995 - protein, 7 aa, synthetic construct
GYTFTAY

SEQ ID NO: 996 - protein, 7 aa, synthetic construct
GYTFTAY

SEQ ID NO: 997 - protein, 7 aa, synthetic construct
GYTFTGY

SEQ ID NO: 998 - protein, 7 aa, synthetic construct
GYTFTAY

SEQ ID NO: 999 - protein, 7 aa, synthetic construct
GYTFTAY

SEQ ID NO: 1000 - protein, 7 aa, synthetic construct
GYTFTAY

SEQ ID NO: 1001 - protein, 7 aa, synthetic construct
GYTFTAY

SEQ ID NO: 1002 - protein, 7 aa, synthetic construct
GYTFTAY

SEQ ID NO: 1003 - protein, 7 aa, synthetic construct
GYTFTAY

SEQ ID NO: 1004 - protein, 7 aa, synthetic construct
GYTFTAY

SEQ ID NO: 1005 - protein, 7 aa, synthetic construct
GYTFTAY

SEQ ID NO: 1006 - protein, 7 aa, synthetic construct
GYTFTGY

SEQ ID NO: 1007 - protein, 7 aa, synthetic construct
GYTFTGY

SEQ ID NO: 1008 - protein, 7 aa, synthetic construct
GYTFTGY

SEQ ID NO: 1009 - protein, 7 aa, synthetic construct
GYTFTGY

SEQ ID NO: 1010 - protein, 7 aa, synthetic construct
GYTFTGY

SEQ ID NO: 1011 - protein, 7 aa, synthetic construct
GYTFTGY

SEQ ID NO: 1012 - protein, 7 aa, synthetic construct
GYTFTGY

SEQ ID NO: 1013 - protein, 7 aa, synthetic construct
GYTFTGY

SEQ ID NO: 1014 - protein, 7 aa, synthetic construct
GYTFTGY

SEQ ID NO: 1015 - protein, 7 aa, synthetic construct
GYTFTGY

SEQ ID NO: 1016 - protein, 7 aa, synthetic construct
GYTFTGY

SEQ ID NO: 1017 - protein, 7 aa, synthetic construct
GYTFTGY

SEQ ID NO: 1018 - protein, 7 aa, synthetic construct
GYTFTGY

SEQ ID NO: 1019 - protein, 7 aa, synthetic construct
GYTFTGY

SEQ ID NO: 1020 - protein, 7 aa, synthetic construct
GYTFTGY

SEQ ID NO: 1021 - protein, 7 aa, synthetic construct
GYTFTGY

SEQ ID NO: 1022 - protein, 7 aa, synthetic construct
GYTFTGY

SEQ ID NO: 1023 - protein, 7 aa, synthetic construct
GYTFTGY

SEQ ID NO: 1024 - protein, 7 aa, synthetic construct
GYTFTAY

SEQ ID NO: 1025 - protein, 7 aa, synthetic construct
GYTFTAY

SEQ ID NO: 1026 - protein, 7 aa, synthetic construct
GYTFTGY

SEQ ID NO: 1027 - protein, 7 aa, synthetic construct
GYTFTGY

SEQ ID NO: 1028 - protein, 7 aa, synthetic construct
GYTFTGY

SEQ ID NO: 1029 - protein, 7 aa, synthetic construct
GYTFTGY

SEQ ID NO: 1030 - protein, 7 aa, synthetic construct
GYTFTGY

SEQ ID NO: 1031 - protein, 7 aa, synthetic construct
GYTFTGY

SEQ ID NO: 1032 - protein, 7 aa, synthetic construct
GYTFTGY

SEQ ID NO: 1033 - protein, 7 aa, synthetic construct
GYTFTGY

SEQ ID NO: 1034 - protein, 7 aa, synthetic construct
GYTFTAY

SEQ ID NO: 1035 - protein, 7 aa, synthetic construct
GYTFTAY

SEQ ID NO: 1036 - protein, 7 aa, synthetic construct
GYTFTGY

SEQ ID NO: 1037 - protein, 7 aa, synthetic construct
GYTFTGY

SEQ ID NO: 1038 - protein, 7 aa, synthetic construct
GYTFTGY

SEQ ID NO: 1039 - protein, 7 aa, synthetic construct
GYTFTGY

SEQ ID NO: 1040 - protein, 7 aa, synthetic construct
GYTFTGY

SEQ ID NO: 1041 - protein, 7 aa, synthetic construct
GYTFTAY

SEQ ID NO: 1042 - protein, 7 aa, synthetic construct
GYTFTAY

SEQ ID NO: 1043 - protein, 7 aa, synthetic construct
GYTFTAY

SEQ ID NO: 1044 - protein, 7 aa, synthetic construct
GYTFTAY

SEQ ID NO: 1045 - protein, 7 aa, synthetic construct
GYTFTGY

SEQ ID NO: 1046 - protein, 7 aa, synthetic construct
GYTFTGY

SEQ ID NO: 1047 - protein, 7 aa, synthetic construct
GYTFTAY

SEQ ID NO: 1048 - protein, 7 aa, synthetic construct
GYTFTAY

SEQ ID NO: 1049 - protein, 7 aa, synthetic construct
GYTFTGY

SEQ ID NO: 1050 - protein, 7 aa, synthetic construct
GYTFTGY

SEQ ID NO: 1051 - protein, 7 aa, synthetic construct
GYTFTGY

SEQ ID NO: 1052 - protein, 7 aa, synthetic construct
GYTFTGY

SEQ ID NO: 1053 - protein, 7 aa, synthetic construct
GYTFTAY

SEQ ID NO: 1054 - protein, 7 aa, synthetic construct
GYTFTGY

SEQ ID NO: 1055 - protein, 7 aa, synthetic construct
GYTFTGY

SEQ ID NO: 1056 - protein, 7 aa, synthetic construct
GYTFTGY

SEQ ID NO: 1057 - protein, 7 aa, synthetic construct
GYTFTGY

SEQ ID NO: 1058 - protein, 7 aa, synthetic construct
GYTFNGY

SEQ ID NO: 1059 - protein, 7 aa, synthetic construct
GYTFTGY

SEQ ID NO: 1060 - protein, 7 aa, synthetic construct
GYTFTAY

SEQ ID NO: 1061 - protein, 7 aa, synthetic construct
GYTFTAY

SEQ ID NO: 1062 - protein, 7 aa, synthetic construct
GYTFTGY

SEQ ID NO: 1063 - protein, 7 aa, synthetic construct
GYTFTGY

SEQ ID NO: 1064 - protein, 7 aa, synthetic construct
GYTFTGY

SEQ ID NO: 1065 - protein, 7 aa, synthetic construct
GYTFTAY

SEQ ID NO: 1066 - protein, 7 aa, synthetic construct
GYTFTGY

SEQ ID NO: 1067 - protein, 7 aa, synthetic construct
GYTFTAY

SEQ ID NO: 1068 - protein, 7 aa, synthetic construct
GYTFTGY

SEQ ID NO: 1069 - protein, 7 aa, synthetic construct
GYTFTGY

SEQ ID NO: 1070 - protein, 7 aa, synthetic construct
GYTFTGY

SEQ ID NO: 1071 - protein, 7 aa, synthetic construct
GYTFTRY

SEQ ID NO: 1072 - protein, 7 aa, synthetic construct
GYTFTGY

SEQ ID NO: 1073 - protein, 7 aa, synthetic construct
GYTFTVY

SEQ ID NO: 1074 - protein, 7 aa, synthetic construct
GYTFTRY

SEQ ID NO: 1075 - protein, 7 aa, synthetic construct
GYTFTTY

SEQ ID NO: 1076 - protein, 6 aa, synthetic construct
NPKSGG

SEQ ID NO: 1077 - protein, 5 aa, synthetic construct
THSGI

SEQ ID NO: 1078 - protein, 6 aa, synthetic construct
NPNSGG

SEQ ID NO: 1079 - protein, 6 aa, synthetic construct
NPKSGG

SEQ ID NO: 1080 - protein, 6 aa, synthetic construct
NPNSGG

SEQ ID NO: 1081 - protein, 6 aa, synthetic construct
NPNSGG

SEQ ID NO: 1082 - protein, 6 aa, synthetic construct
NPKSGG

SEQ ID NO: 1083 - protein, 6 aa, synthetic construct
NPNSGG

SEQ ID NO: 1084 - protein, 6 aa, synthetic construct
NPKSGG

SEQ ID NO: 1085 - protein, 6 aa, synthetic construct
NPNSGG

SEQ ID NO: 1086 - protein, 6 aa, synthetic construct
NPKSGG

SEQ ID NO: 1087 - protein, 6 aa, synthetic construct
NPNSGG

SEQ ID NO: 1088 - protein, 6 aa, synthetic construct
NPKSGG

SEQ ID NO: 1089 - protein, 6 aa, synthetic construct
NPNSGG

SEQ ID NO: 1090 - protein, 6 aa, synthetic construct
NPKSGG

SEQ ID NO: 1091 - protein, 6 aa, synthetic construct
NPNSGG

SEQ ID NO: 1092 - protein, 6 aa, synthetic construct
NPKSGG

SEQ ID NO: 1093 - protein, 6 aa, synthetic construct
NPKSGG

SEQ ID NO: 1094 - protein, 6 aa, synthetic construct
NPKSGG

SEQ ID NO: 1095 - protein, 6 aa, synthetic construct
NPKSGG

SEQ ID NO: 1096 - protein, 6 aa, synthetic construct
NPKSGG

SEQ ID NO: 1097 - protein, 6 aa, synthetic construct
NPNSGG

SEQ ID NO: 1098 - protein, 6 aa, synthetic construct
NPKSGG

SEQ ID NO: 1099 - protein, 6 aa, synthetic construct
NPKSGG

SEQ ID NO: 1100 - protein, 6 aa, synthetic construct
NPNSGG

SEQ ID NO: 1101 - protein, 6 aa, synthetic construct
NPKSGG

SEQ ID NO: 1102 - protein, 6 aa, synthetic construct
NPNSGG

SEQ ID NO: 1103 - protein, 6 aa, synthetic construct
NPKSGG

SEQ ID NO: 1104 - protein, 6 aa, synthetic construct
NPNSGG

SEQ ID NO: 1105 - protein, 6 aa, synthetic construct
NPKSGG

SEQ ID NO: 1106 - protein, 6 aa, synthetic construct
NPKSGG

SEQ ID NO: 1107 - protein, 6 aa, synthetic construct
NPNSGG

SEQ ID NO: 1108 - protein, 6 aa, synthetic construct
NPKSGG

SEQ ID NO: 1109 - protein, 6 aa, synthetic construct
NPNSGG

SEQ ID NO: 1110 - protein, 6 aa, synthetic construct
NPKSGG

SEQ ID NO: 1111 - protein, 6 aa, synthetic construct
NPNSGG

SEQ ID NO: 1112 - protein, 6 aa, synthetic construct
NPKSGG

SEQ ID NO: 1113 - protein, 6 aa, synthetic construct
NPNSGG

SEQ ID NO: 1114 - protein, 6 aa, synthetic construct
NPKSGG

SEQ ID NO: 1115 - protein, 6 aa, synthetic construct
NPKSGG

SEQ ID NO: 1116 - protein, 6 aa, synthetic construct
NPNSGG

SEQ ID NO: 1117 - protein, 6 aa, synthetic construct
NPKSGG

SEQ ID NO: 1118 - protein, 6 aa, synthetic construct
HPNSGG

SEQ ID NO: 1119 - protein, 6 aa, synthetic construct
HPKSGG

SEQ ID NO: 1120 - protein, 6 aa, synthetic construct
NPKSGG

SEQ ID NO: 1121 - protein, 6 aa, synthetic construct
NPNSGG

SEQ ID NO: 1122 - protein, 6 aa, synthetic construct
NPKSGG

SEQ ID NO: 1123 - protein, 6 aa, synthetic construct
NPNSGG

SEQ ID NO: 1124 - protein, 6 aa, synthetic construct
NPKSGG

SEQ ID NO: 1125 - protein, 6 aa, synthetic construct
NPNSGG

SEQ ID NO: 1126 - protein, 6 aa, synthetic construct
NPKSGG

SEQ ID NO: 1127 - protein, 6 aa, synthetic construct
NPNSGG

SEQ ID NO: 1128 - protein, 6 aa, synthetic construct
NPKSGG

SEQ ID NO: 1129 - protein, 6 aa, synthetic construct
NPNSGG

SEQ ID NO: 1130 - protein, 6 aa, synthetic construct
NPKSGG

SEQ ID NO: 1131 - protein, 6 aa, synthetic construct
KPNSGG

SEQ ID NO: 1132 - protein, 6 aa, synthetic construct
KPKSGG

SEQ ID NO: 1133 - protein, 6 aa, synthetic construct
NPNSGG

SEQ ID NO: 1134 - protein, 6 aa, synthetic construct
NPKSGG

SEQ ID NO: 1135 - protein, 6 aa, synthetic construct
NPNSGG

SEQ ID NO: 1136 - protein, 6 aa, synthetic construct
NPKSGG

SEQ ID NO: 1137 - protein, 6 aa, synthetic construct
NPNSGG

SEQ ID NO: 1138 - protein, 6 aa, synthetic construct
NPKSGG

SEQ ID NO: 1139 - protein, 6 aa, synthetic construct
KPNSGG

SEQ ID NO: 1140 - protein, 6 aa, synthetic construct
KPKSGG

SEQ ID NO: 1141 - protein, 6 aa, synthetic construct
NPNSGG

SEQ ID NO: 1142 - protein, 6 aa, synthetic construct
NPKSGG

SEQ ID NO: 1143 - protein, 6 aa, synthetic construct
NPNSGG

SEQ ID NO: 1144 - protein, 6 aa, synthetic construct
NPKSGG

SEQ ID NO: 1145 - protein, 6 aa, synthetic construct
NPNSGG

SEQ ID NO: 1146 - protein, 6 aa, synthetic construct
NPNSGG

SEQ ID NO: 1147 - protein, 6 aa, synthetic construct
NPKSGG

SEQ ID NO: 1148 - protein, 6 aa, synthetic construct
NPNSGA

SEQ ID NO: 1149 - protein, 6 aa, synthetic construct
NPKSGA

SEQ ID NO: 1150 - protein, 6 aa, synthetic construct
NPNSGG

SEQ ID NO: 1151 - protein, 6 aa, synthetic construct
NPKSGG

SEQ ID NO: 1152 - protein, 6 aa, synthetic construct
NPNSGG

SEQ ID NO: 1153 - protein, 6 aa, synthetic construct
NPKSGG

SEQ ID NO: 1154 - protein, 6 aa, synthetic construct
NPKSGG

SEQ ID NO: 1155 - protein, 6 aa, synthetic construct
NPKSGG

SEQ ID NO: 1156 - protein, 6 aa, synthetic construct
NPNSGG

SEQ ID NO: 1157 - protein, 6 aa, synthetic construct
NPKSGG

SEQ ID NO: 1158 - protein, 6 aa, synthetic construct
NPNSGG

SEQ ID NO: 1159 - protein, 6 aa, synthetic construct
NPKSGG

SEQ ID NO: 1160 - protein, 6 aa, synthetic construct
NPNSGG

SEQ ID NO: 1161 - protein, 6 aa, synthetic construct
NPKSGG

SEQ ID NO: 1162 - protein, 6 aa, synthetic construct
NPNSGG

SEQ ID NO: 1163 - protein, 6 aa, synthetic construct
NPKSGG

SEQ ID NO: 1164 - protein, 6 aa, synthetic construct
NPNSGG

SEQ ID NO: 1165 - protein, 6 aa, synthetic construct
NPNSGG

SEQ ID NO: 1166 - protein, 6 aa, synthetic construct
NPNSGG

SEQ ID NO: 1167 - protein, 6 aa, synthetic construct
NPNSGG

SEQ ID NO: 1168 - protein, 6 aa, synthetic construct
NPNSGG

SEQ ID NO: 1169 - protein, 6 aa, synthetic construct
NPNSGG

SEQ ID NO: 1170 - protein, 6 aa, synthetic construct
NPNSGG

SEQ ID NO: 1171 - protein, 6 aa, synthetic construct
NPNSGG

SEQ ID NO: 1172 - protein, 6 aa, synthetic construct
NPNSGG

SEQ ID NO: 1173 - protein, 6 aa, synthetic construct
NPNSGG

SEQ ID NO: 1174 - protein, 6 aa, synthetic construct
NPNSGG

SEQ ID NO: 1175 - protein, 6 aa, synthetic construct
NPKSGG

SEQ ID NO: 1176 - protein, 6 aa, synthetic construct
NPNSGG

SEQ ID NO: 1177 - protein, 6 aa, synthetic construct
NPNSGG

SEQ ID NO: 1178 - protein, 6 aa, synthetic construct
NPNSGG

SEQ ID NO: 1179 - protein, 6 aa, synthetic construct
NPKSGG

SEQ ID NO: 1180 - protein, 6 aa, synthetic construct
NTNTGN

SEQ ID NO: 1181 - protein, 6 aa, synthetic construct
NPKSGG

SEQ ID NO: 1182 - protein, 6 aa, synthetic construct
NPNSGG

SEQ ID NO: 1183 - protein, 6 aa, synthetic construct
NTNTGN

SEQ ID NO: 1184 - protein, 6 aa, synthetic construct
NTNTGN

SEQ ID NO: 1185 - protein, 7 aa, synthetic construct
GSFDAFD

SEQ ID NO: 1186 - protein, 13 aa, synthetic construct
QVGTTDYYYFYMD

SEQ ID NO: 1187 - protein, 7 aa, synthetic construct
GSFDAFD

SEQ ID NO: 1188 - protein, 7 aa, synthetic construct
GSFDAFD

SEQ ID NO: 1189 - protein, 7 aa, synthetic construct
GSFDAFD

SEQ ID NO: 1190 - protein, 7 aa, synthetic construct
GSFDAFD

SEQ ID NO: 1191 - protein, 7 aa, synthetic construct
GSFDAFD

SEQ ID NO: 1192 - protein, 7 aa, synthetic construct
GSYDAFD

SEQ ID NO: 1193 - protein, 7 aa, synthetic construct
GSYDAFD

SEQ ID NO: 1194 - protein, 7 aa, synthetic construct
GSFDAFD

SEQ ID NO: 1195 - protein, 7 aa, synthetic construct
GSFDAFD

SEQ ID NO: 1196 - protein, 7 aa, synthetic construct
GSYDAFD

SEQ ID NO: 1197 - protein, 7 aa, synthetic construct
GSYDAFD

SEQ ID NO: 1198 - protein, 7 aa, synthetic construct
GSYDAFD

SEQ ID NO: 1199 - protein, 7 aa, synthetic construct
GSYDAFD

SEQ ID NO: 1200 - protein, 7 aa, synthetic construct
GSFDAFD

SEQ ID NO: 1201 - protein, 7 aa, synthetic construct
GSFDAFD

SEQ ID NO: 1202 - protein, 7 aa, synthetic construct
GSFDAFD

SEQ ID NO: 1203 - protein, 7 aa, synthetic construct
GSFDAFD

SEQ ID NO: 1204 - protein, 7 aa, synthetic construct
GSYDAFD

SEQ ID NO: 1205 - protein, 7 aa, synthetic construct
GSYDAFD

SEQ ID NO: 1206 - protein, 7 aa, synthetic construct
GSFDAFD

SEQ ID NO: 1207 - protein, 7 aa, synthetic construct
GSFDAFD

SEQ ID NO: 1208 - protein, 7 aa, synthetic construct
GSFDAFD

SEQ ID NO: 1209 - protein, 7 aa, synthetic construct
GSYDAFD

SEQ ID NO: 1210 - protein, 7 aa, synthetic construct
GSYDAFD

SEQ ID NO: 1211 - protein, 7 aa, synthetic construct
GSYDAFD

SEQ ID NO: 1212 - protein, 7 aa, synthetic construct
GSYDAFD

SEQ ID NO: 1213 - protein, 7 aa, synthetic construct
GSFDAFD

SEQ ID NO: 1214 - protein, 7 aa, synthetic construct
GSFDAFD

SEQ ID NO: 1215 - protein, 7 aa, synthetic construct
GSYDAFD

SEQ ID NO: 1216 - protein, 7 aa, synthetic construct
GSYDAFD

SEQ ID NO: 1217 - protein, 7 aa, synthetic construct
GSYDAFD

SEQ ID NO: 1218 - protein, 7 aa, synthetic construct
GSFDAFD

SEQ ID NO: 1219 - protein, 7 aa, synthetic construct
GSFDAFD

SEQ ID NO: 1220 - protein, 7 aa, synthetic construct
GSFDAFD

SEQ ID NO: 1221 - protein, 7 aa, synthetic construct
GSFDAFD

SEQ ID NO: 1222 - protein, 7 aa, synthetic construct
GSFDAFD

SEQ ID NO: 1223 - protein, 7 aa, synthetic construct
GSFDAFD

SEQ ID NO: 1224 - protein, 7 aa, synthetic construct
GSYDAFD

SEQ ID NO: 1225 - protein, 7 aa, synthetic construct
GSYDAFD

SEQ ID NO: 1226 - protein, 7 aa, synthetic construct
GSYDAFD

SEQ ID NO: 1227 - protein, 7 aa, synthetic construct
GSYDAFD

SEQ ID NO: 1228 - protein, 7 aa, synthetic construct
GSYDAFD

SEQ ID NO: 1229 - protein, 7 aa, synthetic construct
GSFDAFD

SEQ ID NO: 1230 - protein, 7 aa, synthetic construct
GSFDAFD

SEQ ID NO: 1231 - protein, 7 aa, synthetic construct
GSFDAFD

SEQ ID NO: 1232 - protein, 7 aa, synthetic construct
GSFDAFD

SEQ ID NO: 1233 - protein, 7 aa, synthetic construct
GSFDAFD

SEQ ID NO: 1234 - protein, 7 aa, synthetic construct
GSFDAFD

SEQ ID NO: 1235 - protein, 7 aa, synthetic construct
GSFDAFD

SEQ ID NO: 1236 - protein, 7 aa, synthetic construct
GSFDAFD

SEQ ID NO: 1237 - protein, 7 aa, synthetic construct
GSFDAFD

SEQ ID NO: 1238 - protein, 7 aa, synthetic construct
GSFDAFD

SEQ ID NO: 1239 - protein, 7 aa, synthetic construct
GSFDAFD

SEQ ID NO: 1240 - protein, 7 aa, synthetic construct
GSYDAFD

SEQ ID NO: 1241 - protein, 7 aa, synthetic construct
GSYDAFD

SEQ ID NO: 1242 - protein, 7 aa, synthetic construct
GSFDAFD

SEQ ID NO: 1243 - protein, 7 aa, synthetic construct
GSFDAFD

SEQ ID NO: 1244 - protein, 7 aa, synthetic construct
GSFDAFD

SEQ ID NO: 1245 - protein, 7 aa, synthetic construct
GSFDAFD

SEQ ID NO: 1246 - protein, 7 aa, synthetic construct
GSFDAFD

SEQ ID NO: 1247 - protein, 7 aa, synthetic construct
GSFDAFD

SEQ ID NO: 1248 - protein, 7 aa, synthetic construct
GSYDAFD

SEQ ID NO: 1249 - protein, 7 aa, synthetic construct
GSYDAFD

SEQ ID NO: 1250 - protein, 7 aa, synthetic construct
GSFDAFD

SEQ ID NO: 1251 - protein, 7 aa, synthetic construct
GSFDAFD

SEQ ID NO: 1252 - protein, 7 aa, synthetic construct
GSYDAFD

SEQ ID NO: 1253 - protein, 7 aa, synthetic construct
GSYDAFD

SEQ ID NO: 1254 - protein, 7 aa, synthetic construct
GSFDAFD

SEQ ID NO: 1255 - protein, 7 aa, synthetic construct
GSYDAFD

SEQ ID NO: 1256 - protein, 7 aa, synthetic construct
GSYDAFD

SEQ ID NO: 1257 - protein, 7 aa, synthetic construct
GSFDAFD

SEQ ID NO: 1258 - protein, 7 aa, synthetic construct
GSFDAFD

SEQ ID NO: 1259 - protein, 7 aa, synthetic construct
GSYDAFD

SEQ ID NO: 1260 - protein, 7 aa, synthetic construct
GSYDAFD

SEQ ID NO: 1261 - protein, 7 aa, synthetic construct
GSYDAFD

SEQ ID NO: 1262 - protein, 7 aa, synthetic construct
GSYDAFD

SEQ ID NO: 1263 - protein, 7 aa, synthetic construct
GSYDAFD

SEQ ID NO: 1264 - protein, 7 aa, synthetic construct
GSYDAFD

SEQ ID NO: 1265 - protein, 7 aa, synthetic construct
GSFDAFD

SEQ ID NO: 1266 - protein, 7 aa, synthetic construct
GSFDAFD

SEQ ID NO: 1267 - protein, 7 aa, synthetic construct
GSFDAFD

SEQ ID NO: 1268 - protein, 7 aa, synthetic construct
GSFDAFD

SEQ ID NO: 1269 - protein, 7 aa, synthetic construct
GSFDAFD

SEQ ID NO: 1270 - protein, 7 aa, synthetic construct
GSFDAFD

SEQ ID NO: 1271 - protein, 7 aa, synthetic construct
GSYDAFD

SEQ ID NO: 1272 - protein, 7 aa, synthetic construct
GSFDAFD

SEQ ID NO: 1273 - protein, 7 aa, synthetic construct
GSFDAFD

SEQ ID NO: 1274 - protein, 7 aa, synthetic construct
GSFDAFD

SEQ ID NO: 1275 - protein, 7 aa, synthetic construct
GSYDAFD

SEQ ID NO: 1276 - protein, 7 aa, synthetic construct
GSFDAFD

SEQ ID NO: 1277 - protein, 7 aa, synthetic construct
GSYDAFD

SEQ ID NO: 1278 - protein, 7 aa, synthetic construct
GSIDAFD

SEQ ID NO: 1279 - protein, 7 aa, synthetic construct
GSYDAFD

SEQ ID NO: 1280 - protein, 7 aa, synthetic construct
GSFDAFD

SEQ ID NO: 1281 - protein, 7 aa, synthetic construct
GSFDAFD

SEQ ID NO: 1282 - protein, 7 aa, synthetic construct
GSFDAFD

SEQ ID NO: 1283 - protein, 7 aa, synthetic construct
GSFDAFD

SEQ ID NO: 1284 - protein, 7 aa, synthetic construct
GSFDAFD

SEQ ID NO: 1285 - protein, 7 aa, synthetic construct
GSFDAFD

SEQ ID NO: 1286 - protein, 7 aa, synthetic construct
GSYDAFD

SEQ ID NO: 1287 - protein, 7 aa, synthetic construct
GSYDAFD

SEQ ID NO: 1288 - protein, 7 aa, synthetic construct
GSFDAFD

SEQ ID NO: 1289 - protein, 7 aa, synthetic construct
NWNYVSD

SEQ ID NO: 1290 - protein, 7 aa, synthetic construct
GSFDAFD

SEQ ID NO: 1291 - protein, 7 aa, synthetic construct
GSFDAFD

SEQ ID NO: 1292 - protein, 7 aa, synthetic construct
NWNYDFD

SEQ ID NO: 1293 - protein, 7 aa, synthetic construct
NWNYDLD

SEQ ID NO: 1294 - protein, 7 aa, synthetic construct
SQSISRY

SEQ ID NO: 1295 - protein, 7 aa, synthetic construct
SQSIRRY

SEQ ID NO: 1296 - protein, 7 aa, synthetic construct
SQSISRY

SEQ ID NO: 1297 - protein, 7 aa, synthetic construct
SQSISRY

SEQ ID NO: 1298 - protein, 7 aa, synthetic construct
SQSISSY

SEQ ID NO: 1299 - protein, 7 aa, synthetic construct
SQSISRY

SEQ ID NO: 1300 - protein, 7 aa, synthetic construct
SQSISRY

SEQ ID NO: 1301 - protein, 7 aa, synthetic construct
SQSISSY

SEQ ID NO: 1302 - protein, 7 aa, synthetic construct
SQSISSY

SEQ ID NO: 1303 - protein, 7 aa, synthetic construct
SQSISSY

SEQ ID NO: 1304 - protein, 7 aa, synthetic construct
SQSISSY

SEQ ID NO: 1305 - protein, 7 aa, synthetic construct
SQSISSY

SEQ ID NO: 1306 - protein, 7 aa, synthetic construct
SQSISSY

SEQ ID NO: 1307 - protein, 7 aa, synthetic construct
SQSISSY

SEQ ID NO: 1308 - protein, 7 aa, synthetic construct
SQSISSY

SEQ ID NO: 1309 - protein, 7 aa, synthetic construct
SQSISSY

SEQ ID NO: 1310 - protein, 7 aa, synthetic construct
SQSISSY

SEQ ID NO: 1311 - protein, 7 aa, synthetic construct
SQSISSY

SEQ ID NO: 1312 - protein, 7 aa, synthetic construct
SQSISSY

SEQ ID NO: 1313 - protein, 7 aa, synthetic construct
SQSISSY

SEQ ID NO: 1314 - protein, 7 aa, synthetic construct
SQSISSY

SEQ ID NO: 1315 - protein, 7 aa, synthetic construct
SQDISNY

SEQ ID NO: 1316 - protein, 7 aa, synthetic construct
SQDISNY

SEQ ID NO: 1317 - protein, 7 aa, synthetic construct
SQGISRY

SEQ ID NO: 1318 - protein, 7 aa, synthetic construct
SQSISSY

SEQ ID NO: 1319 - protein, 7 aa, synthetic construct
SQSISSY

SEQ ID NO: 1320 - protein, 7 aa, synthetic construct
SQSISSY

SEQ ID NO: 1321 - protein, 7 aa, synthetic construct
SQSISSY

SEQ ID NO: 1322 - protein, 7 aa, synthetic construct
SQSISRY

SEQ ID NO: 1323 - protein, 7 aa, synthetic construct
SQSISRY

SEQ ID NO: 1324 - protein, 7 aa, synthetic construct
SQSISSY

SEQ ID NO: 1325 - protein, 7 aa, synthetic construct
SQSISSY

SEQ ID NO: 1326 - protein, 7 aa, synthetic construct
SQSISSY

SEQ ID NO: 1327 - protein, 7 aa, synthetic construct
SQSISSY

SEQ ID NO: 1328 - protein, 7 aa, synthetic construct
SQSISSY

SEQ ID NO: 1329 - protein, 7 aa, synthetic construct
SQSISSY

SEQ ID NO: 1330 - protein, 7 aa, synthetic construct
SQSISSY

SEQ ID NO: 1331 - protein, 7 aa, synthetic construct
SQSISSY

SEQ ID NO: 1332 - protein, 7 aa, synthetic construct
SQSISSY

SEQ ID NO: 1333 - protein, 7 aa, synthetic construct
SQSISSY

SEQ ID NO: 1334 - protein, 7 aa, synthetic construct
SQSISSY

SEQ ID NO: 1335 - protein, 7 aa, synthetic construct
SQSISSY

SEQ ID NO: 1336 - protein, 7 aa, synthetic construct
SQSISSY

SEQ ID NO: 1337 - protein, 7 aa, synthetic construct
SQSISSY

SEQ ID NO: 1338 - protein, 7 aa, synthetic construct
SQSISRY

SEQ ID NO: 1339 - protein, 7 aa, synthetic construct
SQSISSY

SEQ ID NO: 1340 - protein, 7 aa, synthetic construct
SQSISSY

SEQ ID NO: 1341 - protein, 7 aa, synthetic construct
SQSISNY

SEQ ID NO: 1342 - protein, 7 aa, synthetic construct
SQSISNY

SEQ ID NO: 1343 - protein, 7 aa, synthetic construct
SQSISSY

SEQ ID NO: 1344 - protein, 7 aa, synthetic construct
SQSISSY

SEQ ID NO: 1345 - protein, 7 aa, synthetic construct
SQSISSY

SEQ ID NO: 1346 - protein, 7 aa, synthetic construct
SQSISSY

SEQ ID NO: 1347 - protein, 7 aa, synthetic construct
SQSISSY

SEQ ID NO: 1348 - protein, 7 aa, synthetic construct
SQSISSY

SEQ ID NO: 1349 - protein, 7 aa, synthetic construct
SQSISSY

SEQ ID NO: 1350 - protein, 7 aa, synthetic construct
SQSISSY

SEQ ID NO: 1351 - protein, 7 aa, synthetic construct
SQSISSY

SEQ ID NO: 1352 - protein, 7 aa, synthetic construct
SQSISSY

SEQ ID NO: 1353 - protein, 7 aa, synthetic construct
SQTISSY

SEQ ID NO: 1354 - protein, 7 aa, synthetic construct
SQTISSY

SEQ ID NO: 1355 - protein, 7 aa, synthetic construct
SQSISKY

SEQ ID NO: 1356 - protein, 7 aa, synthetic construct
SQSISKY

SEQ ID NO: 1357 - protein, 7 aa, synthetic construct
SQSISSY

SEQ ID NO: 1358 - protein, 7 aa, synthetic construct
SQSISSY

SEQ ID NO: 1359 - protein, 7 aa, synthetic construct
SQSISSY

SEQ ID NO: 1360 - protein, 7 aa, synthetic construct
SQSISSY

SEQ ID NO: 1361 - protein, 7 aa, synthetic construct
SLSISSY

SEQ ID NO: 1362 - protein, 7 aa, synthetic construct
SLSISSY

SEQ ID NO: 1363 - protein, 7 aa, synthetic construct
SQSISSY

SEQ ID NO: 1364 - protein, 7 aa, synthetic construct
SQSISSY

SEQ ID NO: 1365 - protein, 7 aa, synthetic construct
SQSISSY

SEQ ID NO: 1366 - protein, 7 aa, synthetic construct
SRSISSY

SEQ ID NO: 1367 - protein, 7 aa, synthetic construct
SRSISSY

SEQ ID NO: 1368 - protein, 7 aa, synthetic construct
SQSINSY

SEQ ID NO: 1369 - protein, 7 aa, synthetic construct
SQSIQSY

SEQ ID NO: 1370 - protein, 7 aa, synthetic construct
SQSISSY

SEQ ID NO: 1371 - protein, 7 aa, synthetic construct
SQSISSY

SEQ ID NO: 1372 - protein, 7 aa, synthetic construct
SQSINSY

SEQ ID NO: 1373 - protein, 7 aa, synthetic construct
SQSIQSY

SEQ ID NO: 1374 - protein, 7 aa, synthetic construct
SQSISSY

SEQ ID NO: 1375 - protein, 7 aa, synthetic construct
SQSISSY

SEQ ID NO: 1376 - protein, 7 aa, synthetic construct
SLSISSY

SEQ ID NO: 1377 - protein, 7 aa, synthetic construct
SLSISSY

SEQ ID NO: 1378 - protein, 7 aa, synthetic construct
SQSISSY

SEQ ID NO: 1379 - protein, 7 aa, synthetic construct
SQTISRY

SEQ ID NO: 1380 - protein, 7 aa, synthetic construct
SQTISRY

SEQ ID NO: 1381 - protein, 7 aa, synthetic construct
SQSISSY

SEQ ID NO: 1382 - protein, 7 aa, synthetic construct
SQSISSY

SEQ ID NO: 1383 - protein, 7 aa, synthetic construct
SQSISRY

SEQ ID NO: 1384 - protein, 7 aa, synthetic construct
SQSISRY

SEQ ID NO: 1385 - protein, 7 aa, synthetic construct
SQSISSY

SEQ ID NO: 1386 - protein, 7 aa, synthetic construct
SQSISSY

SEQ ID NO: 1387 - protein, 7 aa, synthetic construct
SQSISSY

SEQ ID NO: 1388 - protein, 7 aa, synthetic construct
SQSISSY

SEQ ID NO: 1389 - protein, 7 aa, synthetic construct
SQSISRY

SEQ ID NO: 1390 - protein, 7 aa, synthetic construct
SQSISSY

SEQ ID NO: 1391 - protein, 7 aa, synthetic construct
SQSISSF

SEQ ID NO: 1392 - protein, 7 aa, synthetic construct
SQSISSY

SEQ ID NO: 1393 - protein, 7 aa, synthetic construct
SQSISSY

SEQ ID NO: 1394 - protein, 7 aa, synthetic construct
SQSISSY

SEQ ID NO: 1395 - protein, 7 aa, synthetic construct
SQSISSY

SEQ ID NO: 1396 - protein, 7 aa, synthetic construct
SQSISRY

SEQ ID NO: 1397 - protein, 7 aa, synthetic construct
SQDISNY

SEQ ID NO: 1398 - protein, 8 aa, synthetic construct
SQSVSDSY

SEQ ID NO: 1399 - protein, 7 aa, synthetic construct
SQSISSY

SEQ ID NO: 1400 - protein, 7 aa, synthetic construct
SQSISSY

SEQ ID NO: 1401 - protein, 12 aa, synthetic construct
SQSLVHSDGNTY

SEQ ID NO: 1402 - protein, 12 aa, synthetic construct
SQSLVHSDGNTY

SEQ ID NO: 1403-1511 - skipped (109 entries)

SEQ ID NO: 1512 - protein, 6 aa, synthetic construct
GFSAPL

SEQ ID NO: 1513 - protein, 5 aa, synthetic construct
SYRTI

SEQ ID NO: 1514 - protein, 6 aa, synthetic construct
GDSSPF

SEQ ID NO: 1515 - protein, 6 aa, synthetic construct
GDSSPF

SEQ ID NO: 1516 - protein, 6 aa, synthetic construct
GHSTPF

SEQ ID NO: 1517 - protein, 6 aa, synthetic construct
GDSSPF

SEQ ID NO: 1518 - protein, 6 aa, synthetic construct
GDSSPF

SEQ ID NO: 1519 - protein, 6 aa, synthetic construct
GHSTPF

SEQ ID NO: 1520 - protein, 6 aa, synthetic construct
GHSTPF

SEQ ID NO: 1521 - protein, 6 aa, synthetic construct
GDSTPF

SEQ ID NO: 1522 - protein, 6 aa, synthetic construct
GDSTPF

SEQ ID NO: 1523 - protein, 6 aa, synthetic construct
GDSTPF

SEQ ID NO: 1524 - protein, 6 aa, synthetic construct
GDSTPF

SEQ ID NO: 1525 - protein, 6 aa, synthetic construct
GDSTPF

SEQ ID NO: 1526 - protein, 6 aa, synthetic construct
GDSTPF

SEQ ID NO: 1527 - protein, 6 aa, synthetic construct
GDSSPF

SEQ ID NO: 1528 - protein, 6 aa, synthetic construct
GDSSPF

SEQ ID NO: 1529 - protein, 6 aa, synthetic construct
GHSTPF

SEQ ID NO: 1530 - protein, 6 aa, synthetic construct
GDSTPF

SEQ ID NO: 1531 - protein, 6 aa, synthetic construct
GHSTPF

SEQ ID NO: 1532 - protein, 6 aa, synthetic construct
GYSSPF

SEQ ID NO: 1533 - protein, 6 aa, synthetic construct
GDSTPF

SEQ ID NO: 1534 - protein, 6 aa, synthetic construct
GDSTPF

SEQ ID NO: 1535 - protein, 6 aa, synthetic construct
GFSTPF

SEQ ID NO: 1536 - protein, 6 aa, synthetic construct
GSSPPF

SEQ ID NO: 1537 - protein, 6 aa, synthetic construct
GSSPPF

SEQ ID NO: 1538 - protein, 6 aa, synthetic construct
GYSSPF

SEQ ID NO: 1539 - protein, 6 aa, synthetic construct
GYSSPF

SEQ ID NO: 1540 - protein, 6 aa, synthetic construct
GDSSPF

SEQ ID NO: 1541 - protein, 6 aa, synthetic construct
GDSSPF

SEQ ID NO: 1542 - protein, 6 aa, synthetic construct
GHSTPF

SEQ ID NO: 1543 - protein, 6 aa, synthetic construct
GDSTPF

SEQ ID NO: 1544 - protein, 6 aa, synthetic construct
GDSTPF

SEQ ID NO: 1545 - protein, 6 aa, synthetic construct
GYSSPF

SEQ ID NO: 1546 - protein, 6 aa, synthetic construct
GYSSPF

SEQ ID NO: 1547 - protein, 6 aa, synthetic construct
GHSTPF

SEQ ID NO: 1548 - protein, 6 aa, synthetic construct
GHSTPF

SEQ ID NO: 1549 - protein, 6 aa, synthetic construct
GDSTPF

SEQ ID NO: 1550 - protein, 6 aa, synthetic construct
GDSTPF

SEQ ID NO: 1551 - protein, 6 aa, synthetic construct
GDSTPF

SEQ ID NO: 1552 - protein, 6 aa, synthetic construct
GDSTPF

SEQ ID NO: 1553 - protein, 6 aa, synthetic construct
GDSTPF

SEQ ID NO: 1554 - protein, 6 aa, synthetic construct
GYSSPF

SEQ ID NO: 1555 - protein, 6 aa, synthetic construct
GYSSPF

SEQ ID NO: 1556 - protein, 6 aa, synthetic construct
GDSSPF

SEQ ID NO: 1557 - protein, 6 aa, synthetic construct
GYSSPF

SEQ ID NO: 1558 - protein, 6 aa, synthetic construct
GYSSPF

SEQ ID NO: 1559 - protein, 6 aa, synthetic construct
GYSSPF

SEQ ID NO: 1560 - protein, 6 aa, synthetic construct
GYSSPF

SEQ ID NO: 1561 - protein, 6 aa, synthetic construct
GYSSPF

SEQ ID NO: 1562 - protein, 6 aa, synthetic construct
GYSSPF

SEQ ID NO: 1563 - protein, 6 aa, synthetic construct
GDNTPF

SEQ ID NO: 1564 - protein, 6 aa, synthetic construct
GDNTPF

SEQ ID NO: 1565 - protein, 6 aa, synthetic construct
GHSTPF

SEQ ID NO: 1566 - protein, 6 aa, synthetic construct
GHSTPF

SEQ ID NO: 1567 - protein, 6 aa, synthetic construct
GYSSPF

SEQ ID NO: 1568 - protein, 6 aa, synthetic construct
GYSSPF

SEQ ID NO: 1569 - protein, 6 aa, synthetic construct
GHSTPF

SEQ ID NO: 1570 - protein, 6 aa, synthetic construct
GHSTPF

SEQ ID NO: 1571 - protein, 6 aa, synthetic construct
GDSTPF

SEQ ID NO: 1572 - protein, 6 aa, synthetic construct
GDSTPF

SEQ ID NO: 1573 - protein, 6 aa, synthetic construct
GHSTPF

SEQ ID NO: 1574 - protein, 6 aa, synthetic construct
GHSTPF

SEQ ID NO: 1575 - protein, 6 aa, synthetic construct
GDSTPF

SEQ ID NO: 1576 - protein, 6 aa, synthetic construct
GDSTPF

SEQ ID NO: 1577 - protein, 6 aa, synthetic construct
GYSSPF

SEQ ID NO: 1578 - protein, 6 aa, synthetic construct
GYSSPF

SEQ ID NO: 1579 - protein, 6 aa, synthetic construct
GHSTPF

SEQ ID NO: 1580 - protein, 6 aa, synthetic construct
GHSTPF

SEQ ID NO: 1581 - protein, 6 aa, synthetic construct
GDSTPF

SEQ ID NO: 1582 - protein, 6 aa, synthetic construct
GDSTPF

SEQ ID NO: 1583 - protein, 6 aa, synthetic construct
GDSTPF

SEQ ID NO: 1584 - protein, 6 aa, synthetic construct
GYSSPF

SEQ ID NO: 1585 - protein, 6 aa, synthetic construct
GYSSPF

SEQ ID NO: 1586 - protein, 6 aa, synthetic construct
GYSTPF

SEQ ID NO: 1587 - protein, 6 aa, synthetic construct
GYSTPF

SEQ ID NO: 1588 - protein, 6 aa, synthetic construct
GDNTPF

SEQ ID NO: 1589 - protein, 6 aa, synthetic construct
GDNTPF

SEQ ID NO: 1590 - protein, 6 aa, synthetic construct
GYSTPF

SEQ ID NO: 1591 - protein, 6 aa, synthetic construct
GYSTPF

SEQ ID NO: 1592 - protein, 6 aa, synthetic construct
GDSTPF

SEQ ID NO: 1593 - protein, 6 aa, synthetic construct
GDSTPF

SEQ ID NO: 1594 - protein, 6 aa, synthetic construct
GHSTPF

SEQ ID NO: 1595 - protein, 6 aa, synthetic construct
GHSTPF

SEQ ID NO: 1596 - protein, 6 aa, synthetic construct
GYSSPF

SEQ ID NO: 1597 - protein, 6 aa, synthetic construct
SYSTPF

SEQ ID NO: 1598 - protein, 6 aa, synthetic construct
GYSTPF

SEQ ID NO: 1599 - protein, 6 aa, synthetic construct
GDSTPF

SEQ ID NO: 1600 - protein, 6 aa, synthetic construct
GYSSPF

SEQ ID NO: 1601 - protein, 6 aa, synthetic construct
GDSSPF

SEQ ID NO: 1602 - protein, 6 aa, synthetic construct
GYSTLF

SEQ ID NO: 1603 - protein, 6 aa, synthetic construct
GYSSPF

SEQ ID NO: 1604 - protein, 6 aa, synthetic construct
GYSNPF

SEQ ID NO: 1605 - protein, 6 aa, synthetic construct
GFSTPF

SEQ ID NO: 1606 - protein, 6 aa, synthetic construct
GYSSPF

SEQ ID NO: 1607 - protein, 6 aa, synthetic construct
GYSSPF

SEQ ID NO: 1608 - protein, 6 aa, synthetic construct
GDSTPF

SEQ ID NO: 1609 - protein, 6 aa, synthetic construct
GDSTPF

SEQ ID NO: 1610 - protein, 6 aa, synthetic construct
GHSTPF

SEQ ID NO: 1611 - protein, 6 aa, synthetic construct
GHSTPF

SEQ ID NO: 1612 - protein, 6 aa, synthetic construct
GHSTPI

SEQ ID NO: 1613 - protein, 6 aa, synthetic construct
GYSSPF

SEQ ID NO: 1614 - protein, 6 aa, synthetic construct
GYDTPF

SEQ ID NO: 1615 - protein, 6 aa, synthetic construct
GDSTPF

SEQ ID NO: 1616 - protein, 6 aa, synthetic construct
YGTSPI

SEQ ID NO: 1617 - protein, 6 aa, synthetic construct
AKSFPL

SEQ ID NO: 1618 - protein, 6 aa, synthetic construct
GYSSPF

SEQ ID NO: 1619 - protein, 6 aa, synthetic construct
VTQFPI

SEQ ID NO: 1620 - protein, 6 aa, synthetic construct
ATQFPI

SEQ ID NO: 1621 - protein, 8 aa, synthetic construct
GYTFTGYY

SEQ ID NO: 1622 - protein, 8 aa, synthetic construct
GGSFSGYY

SEQ ID NO: 1623 - protein, 8 aa, synthetic construct
GYTFTGYY

SEQ ID NO: 1624 - protein, 8 aa, synthetic construct
GYTFTGYY

SEQ ID NO: 1625 - protein, 8 aa, synthetic construct
GYTFTGYY

SEQ ID NO: 1626 - protein, 8 aa, synthetic construct
GYTFTAYY

SEQ ID NO: 1627 - protein, 8 aa, synthetic construct
GYTFTAYY

SEQ ID NO: 1628 - protein, 8 aa, synthetic construct
GYTFTAYY

SEQ ID NO: 1629 - protein, 8 aa, synthetic construct
GYTFTAYY

SEQ ID NO: 1630 - protein, 8 aa, synthetic construct
GYTFTAYY

SEQ ID NO: 1631 - protein, 8 aa, synthetic construct
GYTFTAYY

SEQ ID NO: 1632 - protein, 8 aa, synthetic construct
GYTFTGYY

SEQ ID NO: 1633 - protein, 8 aa, synthetic construct
GYTFTGYY

SEQ ID NO: 1634 - protein, 8 aa, synthetic construct
GYTFTGYY

SEQ ID NO: 1635 - protein, 8 aa, synthetic construct
GYTFTGYY

SEQ ID NO: 1636 - protein, 8 aa, synthetic construct
GYTFTGYY

SEQ ID NO: 1637 - protein, 8 aa, synthetic construct
GYTFTGYY

SEQ ID NO: 1638 - protein, 8 aa, synthetic construct
GYTFTGYY

SEQ ID NO: 1639 - protein, 8 aa, synthetic construct
GYTFTGYY

SEQ ID NO: 1640 - protein, 8 aa, synthetic construct
GYTFTGYY

SEQ ID NO: 1641 - protein, 8 aa, synthetic construct
GYTFTGYY

SEQ ID NO: 1642 - protein, 8 aa, synthetic construct
GYTFTAYY

SEQ ID NO: 1643 - protein, 8 aa, synthetic construct
GYTFTAYY

SEQ ID NO: 1644 - protein, 8 aa, synthetic construct
GYTFTGYY

SEQ ID NO: 1645 - protein, 8 aa, synthetic construct
GYTFTGYY

SEQ ID NO: 1646 - protein, 8 aa, synthetic construct
GYTFTGYY

SEQ ID NO: 1647 - protein, 8 aa, synthetic construct
GYTFTAYY

SEQ ID NO: 1648 - protein, 8 aa, synthetic construct
GYTFTAYY

SEQ ID NO: 1649 - protein, 8 aa, synthetic construct
GYTFTAYY

SEQ ID NO: 1650 - protein, 8 aa, synthetic construct
GYTFTAYY

SEQ ID NO: 1651 - protein, 8 aa, synthetic construct
GYTFTGYF

SEQ ID NO: 1652 - protein, 8 aa, synthetic construct
GYTFTAYY

SEQ ID NO: 1653 - protein, 8 aa, synthetic construct
GYTFTAYY

SEQ ID NO: 1654 - protein, 8 aa, synthetic construct
GYTFTAYY

SEQ ID NO: 1655 - protein, 8 aa, synthetic construct
GYTFTAYY

SEQ ID NO: 1656 - protein, 8 aa, synthetic construct
GYTFTAYY

SEQ ID NO: 1657 - protein, 8 aa, synthetic construct
GYTFTAYY

SEQ ID NO: 1658 - protein, 8 aa, synthetic construct
GYTFTAYY

SEQ ID NO: 1659 - protein, 8 aa, synthetic construct
GYTFTAYY

SEQ ID NO: 1660 - protein, 8 aa, synthetic construct
GYTFTGYY

SEQ ID NO: 1661 - protein, 8 aa, synthetic construct
GYTFTGYY

SEQ ID NO: 1662 - protein, 8 aa, synthetic construct
GYTFTGYY

SEQ ID NO: 1663 - protein, 8 aa, synthetic construct
GYTFTGYY

SEQ ID NO: 1664 - protein, 8 aa, synthetic construct
GYTFTGYY

SEQ ID NO: 1665 - protein, 8 aa, synthetic construct
GYTFTGYF

SEQ ID NO: 1666 - protein, 8 aa, synthetic construct
GYTFTGYY

SEQ ID NO: 1667 - protein, 8 aa, synthetic construct
GYTFTGYY

SEQ ID NO: 1668 - protein, 8 aa, synthetic construct
GYTFTGYY

SEQ ID NO: 1669 - protein, 8 aa, synthetic construct
GYTFTGYY

SEQ ID NO: 1670 - protein, 8 aa, synthetic construct
GYTFTGYF

SEQ ID NO: 1671 - protein, 8 aa, synthetic construct
GYTFTGYF

SEQ ID NO: 1672 - protein, 8 aa, synthetic construct
GYTFTGYY

SEQ ID NO: 1673 - protein, 8 aa, synthetic construct
GYTFTGYY

SEQ ID NO: 1674 - protein, 8 aa, synthetic construct
GYTFTGYY

SEQ ID NO: 1675 - protein, 8 aa, synthetic construct
GYTFTGYY

SEQ ID NO: 1676 - protein, 8 aa, synthetic construct
GYTFTGYY

SEQ ID NO: 1677 - protein, 8 aa, synthetic construct
GYTFTGYY

SEQ ID NO: 1678 - protein, 8 aa, synthetic construct
GYTFTAYY

SEQ ID NO: 1679 - protein, 8 aa, synthetic construct
GYTFTAYY

SEQ ID NO: 1680 - protein, 8 aa, synthetic construct
GYTFTGYY

SEQ ID NO: 1681 - protein, 8 aa, synthetic construct
GYTFTGYY

SEQ ID NO: 1682 - protein, 8 aa, synthetic construct
GYTFTGYY

SEQ ID NO: 1683 - protein, 8 aa, synthetic construct
GYTFTGYY

SEQ ID NO: 1684 - protein, 8 aa, synthetic construct
GYTFTGYY

SEQ ID NO: 1685 - protein, 8 aa, synthetic construct
GYTFTGYY

SEQ ID NO: 1686 - protein, 8 aa, synthetic construct
GYTFTGYY

SEQ ID NO: 1687 - protein, 8 aa, synthetic construct
GYTFTGYY

SEQ ID NO: 1688 - protein, 8 aa, synthetic construct
GYTFTAYY

SEQ ID NO: 1689 - protein, 8 aa, synthetic construct
GYTFTAYY

SEQ ID NO: 1690 - protein, 8 aa, synthetic construct
GYTFTGYY

SEQ ID NO: 1691 - protein, 8 aa, synthetic construct
GYTFTGYY

SEQ ID NO: 1692 - protein, 8 aa, synthetic construct
GYTFTGYY

SEQ ID NO: 1693 - protein, 8 aa, synthetic construct
GYTFTGYY

SEQ ID NO: 1694 - protein, 8 aa, synthetic construct
GYTFTGYY

SEQ ID NO: 1695 - protein, 8 aa, synthetic construct
GYTFTAYY

SEQ ID NO: 1696 - protein, 8 aa, synthetic construct
GYTFTAYY

SEQ ID NO: 1697 - protein, 8 aa, synthetic construct
GYTFTAYY

SEQ ID NO: 1698 - protein, 8 aa, synthetic construct
GYTFTAYY

SEQ ID NO: 1699 - protein, 8 aa, synthetic construct
GYTFTGYY

SEQ ID NO: 1700 - protein, 8 aa, synthetic construct
GYTFTGYY

SEQ ID NO: 1701 - protein, 8 aa, synthetic construct
GYTFTAYY

SEQ ID NO: 1702 - protein, 8 aa, synthetic construct
GYTFTAYY

SEQ ID NO: 1703 - protein, 8 aa, synthetic construct
GYTFTGYY

SEQ ID NO: 1704 - protein, 8 aa, synthetic construct
GYTFTGYY

SEQ ID NO: 1705 - protein, 8 aa, synthetic construct
GYTFTGYY

SEQ ID NO: 1706 - protein, 8 aa, synthetic construct
GYTFTGYY

SEQ ID NO: 1707 - protein, 8 aa, synthetic construct
GYTFTAYY

SEQ ID NO: 1708 - protein, 8 aa, synthetic construct
GYTFTGYF

SEQ ID NO: 1709 - protein, 8 aa, synthetic construct
GYTFTGYY

SEQ ID NO: 1710 - protein, 8 aa, synthetic construct
GYTFTGYY

SEQ ID NO: 1711 - protein, 8 aa, synthetic construct
GYTFTGYY

SEQ ID NO: 1712 - protein, 8 aa, synthetic construct
GYTFNGYY

SEQ ID NO: 1713 - protein, 8 aa, synthetic construct
GYTFTGYY

SEQ ID NO: 1714 - protein, 8 aa, synthetic construct
GYTFTAYY

SEQ ID NO: 1715 - protein, 8 aa, synthetic construct
GYTFTAYY

SEQ ID NO: 1716 - protein, 8 aa, synthetic construct
GYTFTGYY

SEQ ID NO: 1717 - protein, 8 aa, synthetic construct
GYTFTGYY

SEQ ID NO: 1718 - protein, 8 aa, synthetic construct
GYTFTGYY

SEQ ID NO: 1719 - protein, 8 aa, synthetic construct
GYTFTAYY

SEQ ID NO: 1720 - protein, 8 aa, synthetic construct
GYTFTGYY

SEQ ID NO: 1721 - protein, 8 aa, synthetic construct
GYTFTAYY

SEQ ID NO: 1722 - protein, 8 aa, synthetic construct
GYTFTGYY

SEQ ID NO: 1723 - protein, 8 aa, synthetic construct
GYTFTGYY

SEQ ID NO: 1724 - protein, 8 aa, synthetic construct
GYTFTGYY

SEQ ID NO: 1725 - protein, 8 aa, synthetic construct
GYTFTRYG

SEQ ID NO: 1726 - protein, 8 aa, synthetic construct
GYTFTGYY

SEQ ID NO: 1727 - protein, 8 aa, synthetic construct
GYTFTVYY

SEQ ID NO: 1728 - protein, 8 aa, synthetic construct
GYTFTRYG

SEQ ID NO: 1729 - protein, 8 aa, synthetic construct
GYTFTTYG

SEQ ID NO: 1730 - protein, 8 aa, synthetic construct
INPKSGGT

SEQ ID NO: 1731 - protein, 7 aa, synthetic construct
ITHSGIT

SEQ ID NO: 1732 - protein, 8 aa, synthetic construct
INPNSGGT

SEQ ID NO: 1733 - protein, 8 aa, synthetic construct
INPKSGGT

SEQ ID NO: 1734 - protein, 8 aa, synthetic construct
INPNSGGT

SEQ ID NO: 1735 - protein, 8 aa, synthetic construct
INPNSGGT

SEQ ID NO: 1736 - protein, 8 aa, synthetic construct
INPKSGGT

SEQ ID NO: 1737 - protein, 8 aa, synthetic construct
INPNSGGT

SEQ ID NO: 1738 - protein, 8 aa, synthetic construct
INPKSGGT

SEQ ID NO: 1739 - protein, 8 aa, synthetic construct
INPNSGGT

SEQ ID NO: 1740 - protein, 8 aa, synthetic construct
INPKSGGT

SEQ ID NO: 1741 - protein, 8 aa, synthetic construct
INPNSGGT

SEQ ID NO: 1742 - protein, 8 aa, synthetic construct
INPKSGGT

SEQ ID NO: 1743 - protein, 8 aa, synthetic construct
INPNSGGT

SEQ ID NO: 1744 - protein, 8 aa, synthetic construct
INPKSGGT

SEQ ID NO: 1745 - protein, 8 aa, synthetic construct
INPNSGGT

SEQ ID NO: 1746 - protein, 8 aa, synthetic construct
INPKSGGT

SEQ ID NO: 1747 - protein, 8 aa, synthetic construct
INPKSGGT

SEQ ID NO: 1748 - protein, 8 aa, synthetic construct
INPKSGGT

SEQ ID NO: 1749 - protein, 8 aa, synthetic construct
INPKSGGT

SEQ ID NO: 1750 - protein, 8 aa, synthetic construct
INPKSGGT

SEQ ID NO: 1751 - protein, 8 aa, synthetic construct
INPNSGGT

SEQ ID NO: 1752 - protein, 8 aa, synthetic construct
INPKSGGT

SEQ ID NO: 1753 - protein, 8 aa, synthetic construct
INPKSGGT

SEQ ID NO: 1754 - protein, 8 aa, synthetic construct
INPNSGGT

SEQ ID NO: 1755 - protein, 8 aa, synthetic construct
INPKSGGT

SEQ ID NO: 1756 - protein, 8 aa, synthetic construct
INPNSGGT

SEQ ID NO: 1757 - protein, 8 aa, synthetic construct
INPKSGGT

SEQ ID NO: 1758 - protein, 8 aa, synthetic construct
INPNSGGT

SEQ ID NO: 1759 - protein, 8 aa, synthetic construct
INPKSGGT

SEQ ID NO: 1760 - protein, 8 aa, synthetic construct
INPKSGGT

SEQ ID NO: 1761 - protein, 8 aa, synthetic construct
INPNSGGT

SEQ ID NO: 1762 - protein, 8 aa, synthetic construct
INPKSGGT

SEQ ID NO: 1763 - protein, 8 aa, synthetic construct
INPNSGGT

SEQ ID NO: 1764 - protein, 8 aa, synthetic construct
INPKSGGT

SEQ ID NO: 1765 - protein, 8 aa, synthetic construct
VNPNSGGT

SEQ ID NO: 1766 - protein, 8 aa, synthetic construct
VNPKSGGT

SEQ ID NO: 1767 - protein, 8 aa, synthetic construct
INPNSGGT

SEQ ID NO: 1768 - protein, 8 aa, synthetic construct
INPKSGGT

SEQ ID NO: 1769 - protein, 8 aa, synthetic construct
INPKSGGT

SEQ ID NO: 1770 - protein, 8 aa, synthetic construct
INPNSGGT

SEQ ID NO: 1771 - protein, 8 aa, synthetic construct
INPKSGGT

SEQ ID NO: 1772 - protein, 8 aa, synthetic construct
IHPNSGGT

SEQ ID NO: 1773 - protein, 8 aa, synthetic construct
IHPKSGGT

SEQ ID NO: 1774 - protein, 8 aa, synthetic construct
INPKSGGT

SEQ ID NO: 1775 - protein, 8 aa, synthetic construct
INPNSGGT

SEQ ID NO: 1776 - protein, 8 aa, synthetic construct
INPKSGGT

SEQ ID NO: 1777 - protein, 8 aa, synthetic construct
INPNSGGP

SEQ ID NO: 1778 - protein, 8 aa, synthetic construct
INPKSGGP

SEQ ID NO: 1779 - protein, 8 aa, synthetic construct
INPNSGGT

SEQ ID NO: 1780 - protein, 8 aa, synthetic construct
INPKSGGT

SEQ ID NO: 1781 - protein, 8 aa, synthetic construct
INPNSGGT

SEQ ID NO: 1782 - protein, 8 aa, synthetic construct
INPKSGGT

SEQ ID NO: 1783 - protein, 8 aa, synthetic construct
INPNSGGT

SEQ ID NO: 1784 - protein, 8 aa, synthetic construct
INPKSGGT

SEQ ID NO: 1785 - protein, 8 aa, synthetic construct
IKPNSGGT

SEQ ID NO: 1786 - protein, 8 aa, synthetic construct
IKPKSGGT

SEQ ID NO: 1787 - protein, 8 aa, synthetic construct
VNPNSGGT

SEQ ID NO: 1788 - protein, 8 aa, synthetic construct
VNPKSGGT

SEQ ID NO: 1789 - protein, 8 aa, synthetic construct
INPNSGGT

SEQ ID NO: 1790 - protein, 8 aa, synthetic construct
INPKSGGT

SEQ ID NO: 1791 - protein, 8 aa, synthetic construct
INPNSGGT

SEQ ID NO: 1792 - protein, 8 aa, synthetic construct
INPKSGGT

SEQ ID NO: 1793 - protein, 8 aa, synthetic construct
IKPNSGGT

SEQ ID NO: 1794 - protein, 8 aa, synthetic construct
IKPKSGGT

SEQ ID NO: 1795 - protein, 8 aa, synthetic construct
INPNSGGT

SEQ ID NO: 1796 - protein, 8 aa, synthetic construct
INPKSGGT

SEQ ID NO: 1797 - protein, 8 aa, synthetic construct
INPNSGGT

SEQ ID NO: 1798 - protein, 8 aa, synthetic construct
INPKSGGT

SEQ ID NO: 1799 - protein, 8 aa, synthetic construct
INPNSGGT

SEQ ID NO: 1800 - protein, 8 aa, synthetic construct
INPNSGGT

SEQ ID NO: 1801 - protein, 8 aa, synthetic construct
INPKSGGT

SEQ ID NO: 1802 - protein, 8 aa, synthetic construct
INPNSGAT

SEQ ID NO: 1803 - protein, 8 aa, synthetic construct
INPKSGAT

SEQ ID NO: 1804 - protein, 8 aa, synthetic construct
INPNSGGT

SEQ ID NO: 1805 - protein, 8 aa, synthetic construct
INPKSGGT

SEQ ID NO: 1806 - protein, 8 aa, synthetic construct
INPNSGGT

SEQ ID NO: 1807 - protein, 8 aa, synthetic construct
INPKSGGT

SEQ ID NO: 1808 - protein, 8 aa, synthetic construct
INPKSGGT

SEQ ID NO: 1809 - protein, 8 aa, synthetic construct
INPKSGGT

SEQ ID NO: 1810 - protein, 8 aa, synthetic construct
INPNSGGT

SEQ ID NO: 1811 - protein, 8 aa, synthetic construct
INPKSGGT

SEQ ID NO: 1812 - protein, 8 aa, synthetic construct
INPNSGGT

SEQ ID NO: 1813 - protein, 8 aa, synthetic construct
INPKSGGT

SEQ ID NO: 1814 - protein, 8 aa, synthetic construct
INPNSGGT

SEQ ID NO: 1815 - protein, 8 aa, synthetic construct
INPKSGGT

SEQ ID NO: 1816 - protein, 8 aa, synthetic construct
INPNSGGT

SEQ ID NO: 1817 - protein, 8 aa, synthetic construct
INPKSGGT

SEQ ID NO: 1818 - protein, 8 aa, synthetic construct
INPNSGGT

SEQ ID NO: 1819 - protein, 8 aa, synthetic construct
INPNSGGT

SEQ ID NO: 1820 - protein, 8 aa, synthetic construct
INPNSGGT

SEQ ID NO: 1821 - protein, 8 aa, synthetic construct
INPNSGGT

SEQ ID NO: 1822 - protein, 8 aa, synthetic construct
INPNSGGT

SEQ ID NO: 1823 - protein, 8 aa, synthetic construct
INPNSGGT

SEQ ID NO: 1824 - protein, 8 aa, synthetic construct
INPNSGGT

SEQ ID NO: 1825 - protein, 8 aa, synthetic construct
INPNSGGT

SEQ ID NO: 1826 - protein, 8 aa, synthetic construct
INPNSGGT

SEQ ID NO: 1827 - protein, 8 aa, synthetic construct
INPNSGGT

SEQ ID NO: 1828 - protein, 8 aa, synthetic construct
INPNSGGT

SEQ ID NO: 1829 - protein, 8 aa, synthetic construct
INPKSGGT

SEQ ID NO: 1830 - protein, 8 aa, synthetic construct
INPNSGGT

SEQ ID NO: 1831 - protein, 8 aa, synthetic construct
INPNSGGT

SEQ ID NO: 1832 - protein, 8 aa, synthetic construct
INPNSGGT

SEQ ID NO: 1833 - protein, 8 aa, synthetic construct
INPKSGGT

SEQ ID NO: 1834 - protein, 8 aa, synthetic construct
INTNTGNP

SEQ ID NO: 1835 - protein, 8 aa, synthetic construct
INPKSGGT

SEQ ID NO: 1836 - protein, 8 aa, synthetic construct
INPNSGGT

SEQ ID NO: 1837 - protein, 8 aa, synthetic construct
INTNTGNP

SEQ ID NO: 1838 - protein, 8 aa, synthetic construct
INTNTGNP

SEQ ID NO: 1839 - protein, 11 aa, synthetic construct
ATGGSFDAFDI

SEQ ID NO: 1840 - protein, 17 aa, synthetic construct
ARGQVGTTDYYYFYMDV

SEQ ID NO: 1841 - protein, 11 aa, synthetic construct
AVGGSFDAFDI

SEQ ID NO: 1842 - protein, 11 aa, synthetic construct
AVGGSFDAFDI

SEQ ID NO: 1843 - protein, 11 aa, synthetic construct
AVGGSFDAFDI

SEQ ID NO: 1844 - protein, 11 aa, synthetic construct
ATGGSFDAFDI

SEQ ID NO: 1845 - protein, 11 aa, synthetic construct
ATGGSFDAFDI

SEQ ID NO: 1846 - protein, 11 aa, synthetic construct
AVGGSYDAFDI

SEQ ID NO: 1847 - protein, 11 aa, synthetic construct
AVGGSYDAFDI

SEQ ID NO: 1848 - protein, 11 aa, synthetic construct
AVGGSFDAFDI

SEQ ID NO: 1849 - protein, 11 aa, synthetic construct
AVGGSFDAFDI

SEQ ID NO: 1850 - protein, 11 aa, synthetic construct
AVGGSYDAFDI

SEQ ID NO: 1851 - protein, 11 aa, synthetic construct
AVGGSYDAFDI

SEQ ID NO: 1852 - protein, 11 aa, synthetic construct
AVGGSYDAFDI

SEQ ID NO: 1853 - protein, 11 aa, synthetic construct
AVGGSYDAFDI

SEQ ID NO: 1854 - protein, 11 aa, synthetic construct
ATGGSFDAFDI

SEQ ID NO: 1855 - protein, 11 aa, synthetic construct
ATGGSFDAFDI

SEQ ID NO: 1856 - protein, 11 aa, synthetic construct
ATGGSFDAFDI

SEQ ID NO: 1857 - protein, 11 aa, synthetic construct
ATGGSFDAFDI

SEQ ID NO: 1858 - protein, 11 aa, synthetic construct
AVGGSYDAFDI

SEQ ID NO: 1859 - protein, 11 aa, synthetic construct
AVGGSYDAFDI

SEQ ID NO: 1860 - protein, 11 aa, synthetic construct
AVGGSFDAFDI

SEQ ID NO: 1861 - protein, 11 aa, synthetic construct
AVGGSFDAFDI

SEQ ID NO: 1862 - protein, 11 aa, synthetic construct
ATGGSFDAFDI

SEQ ID NO: 1863 - protein, 11 aa, synthetic construct
AVGGSYDAFDI

SEQ ID NO: 1864 - protein, 11 aa, synthetic construct
AVGGSYDAFDI

SEQ ID NO: 1865 - protein, 11 aa, synthetic construct
AVGGSYDAFDI

SEQ ID NO: 1866 - protein, 11 aa, synthetic construct
AVGGSYDAFDI

SEQ ID NO: 1867 - protein, 11 aa, synthetic construct
ASGGSFDAFDI

SEQ ID NO: 1868 - protein, 11 aa, synthetic construct
ASGGSFDAFDI

SEQ ID NO: 1869 - protein, 11 aa, synthetic construct
AVGGSYDAFDI

SEQ ID NO: 1870 - protein, 11 aa, synthetic construct
AVGGSYDAFDI

SEQ ID NO: 1871 - protein, 11 aa, synthetic construct
AVGGSYDAFDI

SEQ ID NO: 1872 - protein, 11 aa, synthetic construct
AVGGSFDAFDI

SEQ ID NO: 1873 - protein, 11 aa, synthetic construct
AVGGSFDAFDI

SEQ ID NO: 1874 - protein, 11 aa, synthetic construct
AVGGSFDAFDI

SEQ ID NO: 1875 - protein, 11 aa, synthetic construct
AVGGSFDAFDI

SEQ ID NO: 1876 - protein, 11 aa, synthetic construct
ATGGSFDAFDI

SEQ ID NO: 1877 - protein, 11 aa, synthetic construct
ATGGSFDAFDI

SEQ ID NO: 1878 - protein, 11 aa, synthetic construct
AVGGSYDAFDI

SEQ ID NO: 1879 - protein, 11 aa, synthetic construct
AVGGSYDAFDI

SEQ ID NO: 1880 - protein, 11 aa, synthetic construct
AVGGSYDAFDI

SEQ ID NO: 1881 - protein, 11 aa, synthetic construct
AVGGSYDAFDI

SEQ ID NO: 1882 - protein, 11 aa, synthetic construct
AVGGSYDAFDI

SEQ ID NO: 1883 - protein, 11 aa, synthetic construct
ASGGSFDAFDI

SEQ ID NO: 1884 - protein, 11 aa, synthetic construct
ATGGSFDAFDI

SEQ ID NO: 1885 - protein, 11 aa, synthetic construct
ATGGSFDAFDI

SEQ ID NO: 1886 - protein, 11 aa, synthetic construct
ATGGSFDAFDI

SEQ ID NO: 1887 - protein, 11 aa, synthetic construct
ATGGSFDAFDI

SEQ ID NO: 1888 - protein, 11 aa, synthetic construct
ATGGSFDAFDI

SEQ ID NO: 1889 - protein, 11 aa, synthetic construct
ATGGSFDAFDI

SEQ ID NO: 1890 - protein, 11 aa, synthetic construct
ATGGSFDAFDV

SEQ ID NO: 1891 - protein, 11 aa, synthetic construct
ATGGSFDAFDV

SEQ ID NO: 1892 - protein, 11 aa, synthetic construct
ATGGSFDAFDI

SEQ ID NO: 1893 - protein, 11 aa, synthetic construct
ATGGSFDAFDI

SEQ ID NO: 1894 - protein, 11 aa, synthetic construct
AVGGSYDAFDI

SEQ ID NO: 1895 - protein, 11 aa, synthetic construct
AVGGSYDAFDI

SEQ ID NO: 1896 - protein, 11 aa, synthetic construct
AVGGSFDAFDI

SEQ ID NO: 1897 - protein, 11 aa, synthetic construct
AVGGSFDAFDI

SEQ ID NO: 1898 - protein, 11 aa, synthetic construct
ATGGSFDAFDI

SEQ ID NO: 1899 - protein, 11 aa, synthetic construct
ATGGSFDAFDI

SEQ ID NO: 1900 - protein, 11 aa, synthetic construct
ATGGSFDAFDI

SEQ ID NO: 1901 - protein, 11 aa, synthetic construct
ATGGSFDAFDI

SEQ ID NO: 1902 - protein, 11 aa, synthetic construct
AVGGSYDAFDI

SEQ ID NO: 1903 - protein, 11 aa, synthetic construct
AVGGSYDAFDI

SEQ ID NO: 1904 - protein, 11 aa, synthetic construct
ATGGSFDAFDI

SEQ ID NO: 1905 - protein, 11 aa, synthetic construct
ATGGSFDAFDI

SEQ ID NO: 1906 - protein, 11 aa, synthetic construct
AVGGSYDAFDI

SEQ ID NO: 1907 - protein, 11 aa, synthetic construct
AVGGSYDAFDI

SEQ ID NO: 1908 - protein, 11 aa, synthetic construct
ATGGSFDAFDI

SEQ ID NO: 1909 - protein, 11 aa, synthetic construct
AVGGSYDAFDI

SEQ ID NO: 1910 - protein, 11 aa, synthetic construct
AVGGSYDAFDI

SEQ ID NO: 1911 - protein, 11 aa, synthetic construct
ATGGSFDAFDI

SEQ ID NO: 1912 - protein, 11 aa, synthetic construct
ATGGSFDAFDI

SEQ ID NO: 1913 - protein, 11 aa, synthetic construct
AVGGSYDAFDI

SEQ ID NO: 1914 - protein, 11 aa, synthetic construct
AVGGSYDAFDI

SEQ ID NO: 1915 - protein, 11 aa, synthetic construct
AVGGSYDAFDI

SEQ ID NO: 1916 - protein, 11 aa, synthetic construct
AVGGSYDAFDI

SEQ ID NO: 1917 - protein, 11 aa, synthetic construct
ATGGSYDAFDI

SEQ ID NO: 1918 - protein, 11 aa, synthetic construct
ATGGSYDAFDI

SEQ ID NO: 1919 - protein, 11 aa, synthetic construct
AVGGSFDAFDI

SEQ ID NO: 1920 - protein, 11 aa, synthetic construct
AVGGSFDAFDI

SEQ ID NO: 1921 - protein, 11 aa, synthetic construct
AVGGSFDAFDI

SEQ ID NO: 1922 - protein, 11 aa, synthetic construct
AVGGSFDAFDI

SEQ ID NO: 1923 - protein, 11 aa, synthetic construct
ATGGSFDAFDI

SEQ ID NO: 1924 - protein, 11 aa, synthetic construct
ATGGSFDAFDI

SEQ ID NO: 1925 - protein, 11 aa, synthetic construct
AVGGSYDAFDI

SEQ ID NO: 1926 - protein, 11 aa, synthetic construct
ASGGSFDAFDI

SEQ ID NO: 1927 - protein, 11 aa, synthetic construct
ATGGSFDAFDI

SEQ ID NO: 1928 - protein, 11 aa, synthetic construct
ASGGSFDAFDI

SEQ ID NO: 1929 - protein, 11 aa, synthetic construct
AVGGSYDAFDI

SEQ ID NO: 1930 - protein, 11 aa, synthetic construct
ATGGSFDAFDI

SEQ ID NO: 1931 - protein, 11 aa, synthetic construct
AVGGSYDAFDI

SEQ ID NO: 1932 - protein, 11 aa, synthetic construct
ASGGSIDAFDI

SEQ ID NO: 1933 - protein, 11 aa, synthetic construct
AVGGSYDAFDI

SEQ ID NO: 1934 - protein, 11 aa, synthetic construct
AVGGSFDAFDI

SEQ ID NO: 1935 - protein, 11 aa, synthetic construct
VTGGSFDAFDV

SEQ ID NO: 1936 - protein, 11 aa, synthetic construct
TSGGSFDAFDI

SEQ ID NO: 1937 - protein, 11 aa, synthetic construct
ATGGSFDAFDI

SEQ ID NO: 1938 - protein, 11 aa, synthetic construct
ASGGSFDAFDI

SEQ ID NO: 1939 - protein, 11 aa, synthetic construct
AVGGSFDAFDI

SEQ ID NO: 1940 - protein, 11 aa, synthetic construct
ATGGSYDAFDI

SEQ ID NO: 1941 - protein, 11 aa, synthetic construct
ATGGSYDAFDI

SEQ ID NO: 1942 - protein, 11 aa, synthetic construct
ATGGSFDAFDI

SEQ ID NO: 1943 - protein, 11 aa, synthetic construct
ARDNWNYVSDY

SEQ ID NO: 1944 - protein, 11 aa, synthetic construct
ATGGSFDAFDI

SEQ ID NO: 1945 - protein, 11 aa, synthetic construct
ASGGSFDAFDI

SEQ ID NO: 1946 - protein, 11 aa, synthetic construct
ARDNWNYDFDY

SEQ ID NO: 1947 - protein, 11 aa, synthetic construct
ARDNWNYDLDY

SEQ ID NO: 1948 - protein, 6 aa, synthetic construct
QSISRY

SEQ ID NO: 1949 - protein, 6 aa, synthetic construct
QSIRRY

SEQ ID NO: 1950 - protein, 6 aa, synthetic construct
QSISRY

SEQ ID NO: 1951 - protein, 6 aa, synthetic construct
QSISRY

SEQ ID NO: 1952 - protein, 6 aa, synthetic construct
QSISSY

SEQ ID NO: 1953 - protein, 6 aa, synthetic construct
QSISRY

SEQ ID NO: 1954 - protein, 6 aa, synthetic construct
QSISRY

SEQ ID NO: 1955 - protein, 6 aa, synthetic construct
QSISSY

SEQ ID NO: 1956 - protein, 6 aa, synthetic construct
QSISSY

SEQ ID NO: 1957 - protein, 6 aa, synthetic construct
QSISSY

SEQ ID NO: 1958 - protein, 6 aa, synthetic construct
QSISSY

SEQ ID NO: 1959 - protein, 6 aa, synthetic construct
QSISSY

SEQ ID NO: 1960 - protein, 6 aa, synthetic construct
QSISSY

SEQ ID NO: 1961 - protein, 6 aa, synthetic construct
QSISSY

SEQ ID NO: 1962 - protein, 6 aa, synthetic construct
QSISSY

SEQ ID NO: 1963 - protein, 6 aa, synthetic construct
QSISSY

SEQ ID NO: 1964 - protein, 6 aa, synthetic construct
QSISSY

SEQ ID NO: 1965 - protein, 6 aa, synthetic construct
QSISSY

SEQ ID NO: 1966 - protein, 6 aa, synthetic construct
QSISSY

SEQ ID NO: 1967 - protein, 6 aa, synthetic construct
QSISSY

SEQ ID NO: 1968 - protein, 6 aa, synthetic construct
QSISSY

SEQ ID NO: 1969 - protein, 6 aa, synthetic construct
QDISNY

SEQ ID NO: 1970 - protein, 6 aa, synthetic construct
QDISNY

SEQ ID NO: 1971 - protein, 6 aa, synthetic construct
QGISRY

SEQ ID NO: 1972 - protein, 6 aa, synthetic construct
QSISSY

SEQ ID NO: 1973 - protein, 6 aa, synthetic construct
QSISSY

SEQ ID NO: 1974 - protein, 6 aa, synthetic construct
QSISSY

SEQ ID NO: 1975 - protein, 6 aa, synthetic construct
QSISSY

SEQ ID NO: 1976 - protein, 6 aa, synthetic construct
QSISRY

SEQ ID NO: 1977 - protein, 6 aa, synthetic construct
QSISRY

SEQ ID NO: 1978 - protein, 6 aa, synthetic construct
QSISSY

SEQ ID NO: 1979 - protein, 6 aa, synthetic construct
QSISSY

SEQ ID NO: 1980 - protein, 6 aa, synthetic construct
QSISSY

SEQ ID NO: 1981 - protein, 6 aa, synthetic construct
QSISSY

SEQ ID NO: 1982 - protein, 6 aa, synthetic construct
QSISSY

SEQ ID NO: 1983 - protein, 6 aa, synthetic construct
QSISSY

SEQ ID NO: 1984 - protein, 6 aa, synthetic construct
QSISSY

SEQ ID NO: 1985 - protein, 6 aa, synthetic construct
QSISSY

SEQ ID NO: 1986 - protein, 6 aa, synthetic construct
QSISSY

SEQ ID NO: 1987 - protein, 6 aa, synthetic construct
QSISSY

SEQ ID NO: 1988 - protein, 6 aa, synthetic construct
QSISSY

SEQ ID NO: 1989 - protein, 6 aa, synthetic construct
QSISSY

SEQ ID NO: 1990 - protein, 6 aa, synthetic construct
QSISSY

SEQ ID NO: 1991 - protein, 6 aa, synthetic construct
QSISSY

SEQ ID NO: 1992 - protein, 6 aa, synthetic construct
QSISRY

SEQ ID NO: 1993 - protein, 6 aa, synthetic construct
QSISSY

SEQ ID NO: 1994 - protein, 6 aa, synthetic construct
QSISSY

SEQ ID NO: 1995 - protein, 6 aa, synthetic construct
QSISNY

SEQ ID NO: 1996 - protein, 6 aa, synthetic construct
QSISNY

SEQ ID NO: 1997 - protein, 6 aa, synthetic construct
QSISSY

SEQ ID NO: 1998 - protein, 6 aa, synthetic construct
QSISSY

SEQ ID NO: 1999 - protein, 6 aa, synthetic construct
QSISSY

SEQ ID NO: 2000 - protein, 6 aa, synthetic construct
QSISSY

SEQ ID NO: 2001 - protein, 6 aa, synthetic construct
QSISSY

SEQ ID NO: 2002 - protein, 6 aa, synthetic construct
QSISSY

SEQ ID NO: 2003 - protein, 6 aa, synthetic construct
QSISSY

SEQ ID NO: 2004 - protein, 6 aa, synthetic construct
QSISSY

SEQ ID NO: 2005 - protein, 6 aa, synthetic construct
QSISSY

SEQ ID NO: 2006 - protein, 6 aa, synthetic construct
QSISSY

SEQ ID NO: 2007 - protein, 6 aa, synthetic construct
QTISSY

SEQ ID NO: 2008 - protein, 6 aa, synthetic construct
QTISSY

SEQ ID NO: 2009 - protein, 6 aa, synthetic construct
QSISKY

SEQ ID NO: 2010 - protein, 6 aa, synthetic construct
QSISKY

SEQ ID NO: 2011 - protein, 6 aa, synthetic construct
QSISSY

SEQ ID NO: 2012 - protein, 6 aa, synthetic construct
QSISSY

SEQ ID NO: 2013 - protein, 6 aa, synthetic construct
QSISSY

SEQ ID NO: 2014 - protein, 6 aa, synthetic construct
QSISSY

SEQ ID NO: 2015 - protein, 6 aa, synthetic construct
LSISSY

SEQ ID NO: 2016 - protein, 6 aa, synthetic construct
LSISSY

SEQ ID NO: 2017 - protein, 6 aa, synthetic construct
QSISSY

SEQ ID NO: 2018 - protein, 6 aa, synthetic construct
QSISSY

SEQ ID NO: 2019 - protein, 6 aa, synthetic construct
QSISSY

SEQ ID NO: 2020 - protein, 6 aa, synthetic construct
RSISSY

SEQ ID NO: 2021 - protein, 6 aa, synthetic construct
RSISSY

SEQ ID NO: 2022 - protein, 6 aa, synthetic construct
QSINSY

SEQ ID NO: 2023 - protein, 6 aa, synthetic construct
QSIQSY

SEQ ID NO: 2024 - protein, 6 aa, synthetic construct
QSISSY

SEQ ID NO: 2025 - protein, 6 aa, synthetic construct
QSISSY

SEQ ID NO: 2026 - protein, 6 aa, synthetic construct
QSINSY

SEQ ID NO: 2027 - protein, 6 aa, synthetic construct
QSIQSY

SEQ ID NO: 2028 - protein, 6 aa, synthetic construct
QSISSY

SEQ ID NO: 2029 - protein, 6 aa, synthetic construct
QSISSY

SEQ ID NO: 2030 - protein, 6 aa, synthetic construct
LSISSY

SEQ ID NO: 2031 - protein, 6 aa, synthetic construct
LSISSY

SEQ ID NO: 2032 - protein, 6 aa, synthetic construct
QSISSY

SEQ ID NO: 2033 - protein, 6 aa, synthetic construct
QTISRY

SEQ ID NO: 2034 - protein, 6 aa, synthetic construct
QTISRY

SEQ ID NO: 2035 - protein, 6 aa, synthetic construct
QSISSY

SEQ ID NO: 2036 - protein, 6 aa, synthetic construct
QSISSY

SEQ ID NO: 2037 - protein, 6 aa, synthetic construct
QSISRY

SEQ ID NO: 2038 - protein, 6 aa, synthetic construct
QSISRY

SEQ ID NO: 2039 - protein, 6 aa, synthetic construct
QSISSY

SEQ ID NO: 2040 - protein, 6 aa, synthetic construct
QSISSY

SEQ ID NO: 2041 - protein, 6 aa, synthetic construct
QSISSY

SEQ ID NO: 2042 - protein, 6 aa, synthetic construct
QSISSY

SEQ ID NO: 2043 - protein, 6 aa, synthetic construct
QSISRY

SEQ ID NO: 2044 - protein, 6 aa, synthetic construct
QSISSY

SEQ ID NO: 2045 - protein, 6 aa, synthetic construct
QSISSF

SEQ ID NO: 2046 - protein, 6 aa, synthetic construct
QSISSY

SEQ ID NO: 2047 - protein, 6 aa, synthetic construct
QSISSY

SEQ ID NO: 2048 - protein, 6 aa, synthetic construct
QSISSY

SEQ ID NO: 2049 - protein, 6 aa, synthetic construct
QSISSY

SEQ ID NO: 2050 - protein, 6 aa, synthetic construct
QSISRY

SEQ ID NO: 2051 - protein, 6 aa, synthetic construct
QDISNY

SEQ ID NO: 2052 - protein, 7 aa, synthetic construct
QSVSDSY

SEQ ID NO: 2053 - protein, 6 aa, synthetic construct
QSISSY

SEQ ID NO: 2054 - protein, 6 aa, synthetic construct
QSISSY

SEQ ID NO: 2055 - protein, 11 aa, synthetic construct
QSLVHSDGNTY

SEQ ID NO: 2056 - protein, 11 aa, synthetic construct
QSLVHSDGNTY

SEQ ID NO: 2057-2165 - skipped (109 entries)

SEQ ID NO: 2166 - protein, 9 aa, synthetic construct
QQGFSAPLT

SEQ ID NO: 2167 - protein, 8 aa, synthetic construct
QQSYRTIT

SEQ ID NO: 2168 - protein, 9 aa, synthetic construct
QQGDSSPFT

SEQ ID NO: 2169 - protein, 9 aa, synthetic construct
QQGDSSPFT

SEQ ID NO: 2170 - protein, 9 aa, synthetic construct
QQGHSTPFT

SEQ ID NO: 2171 - protein, 9 aa, synthetic construct
QQGDSSPFT

SEQ ID NO: 2172 - protein, 9 aa, synthetic construct
QQGDSSPFT

SEQ ID NO: 2173 - protein, 9 aa, synthetic construct
QQGHSTPFT

SEQ ID NO: 2174 - protein, 9 aa, synthetic construct
QQGHSTPFT

SEQ ID NO: 2175 - protein, 9 aa, synthetic construct
QQGDSTPFT

SEQ ID NO: 2176 - protein, 9 aa, synthetic construct
QQGDSTPFT

SEQ ID NO: 2177 - protein, 9 aa, synthetic construct
QQGDSTPFT

SEQ ID NO: 2178 - protein, 9 aa, synthetic construct
QQGDSTPFT

SEQ ID NO: 2179 - protein, 9 aa, synthetic construct
QQGDSTPFT

SEQ ID NO: 2180 - protein, 9 aa, synthetic construct
QQGDSTPFT

SEQ ID NO: 2181 - protein, 9 aa, synthetic construct
QQGDSSPFT

SEQ ID NO: 2182 - protein, 9 aa, synthetic construct
QQGDSSPFT

SEQ ID NO: 2183 - protein, 9 aa, synthetic construct
QQGHSTPFT

SEQ ID NO: 2184 - protein, 9 aa, synthetic construct
QQGDSTPFT

SEQ ID NO: 2185 - protein, 9 aa, synthetic construct
QQGHSTPFT

SEQ ID NO: 2186 - protein, 9 aa, synthetic construct
QQGYSSPFT

SEQ ID NO: 2187 - protein, 9 aa, synthetic construct
QQGDSTPFT

SEQ ID NO: 2188 - protein, 9 aa, synthetic construct
QQGDSTPFT

SEQ ID NO: 2189 - protein, 9 aa, synthetic construct
QQGFSTPFT

SEQ ID NO: 2190 - protein, 9 aa, synthetic construct
QQGSSPPFT

SEQ ID NO: 2191 - protein, 9 aa, synthetic construct
QQGSSPPFT

SEQ ID NO: 2192 - protein, 9 aa, synthetic construct
QQGYSSPFT

SEQ ID NO: 2193 - protein, 9 aa, synthetic construct
QQGYSSPFT

SEQ ID NO: 2194 - protein, 9 aa, synthetic construct
QQGDSSPFT

SEQ ID NO: 2195 - protein, 9 aa, synthetic construct
QQGDSSPFT

SEQ ID NO: 2196 - protein, 9 aa, synthetic construct
QQGHSTPFT

SEQ ID NO: 2197 - protein, 9 aa, synthetic construct
QQGDSTPFT

SEQ ID NO: 2198 - protein, 9 aa, synthetic construct
QQGDSTPFT

SEQ ID NO: 2199 - protein, 9 aa, synthetic construct
QQGYSSPFT

SEQ ID NO: 2200 - protein, 9 aa, synthetic construct
QQGYSSPFT

SEQ ID NO: 2201 - protein, 9 aa, synthetic construct
QQGHSTPFT

SEQ ID NO: 2202 - protein, 9 aa, synthetic construct
QQGHSTPFT

SEQ ID NO: 2203 - protein, 9 aa, synthetic construct
QQGDSTPFT

SEQ ID NO: 2204 - protein, 9 aa, synthetic construct
QQGDSTPFT

SEQ ID NO: 2205 - protein, 9 aa, synthetic construct
QQGDSTPFT

SEQ ID NO: 2206 - protein, 9 aa, synthetic construct
QQGDSTPFT

SEQ ID NO: 2207 - protein, 9 aa, synthetic construct
QQGDSTPFT

SEQ ID NO: 2208 - protein, 9 aa, synthetic construct
QQGYSSPFT

SEQ ID NO: 2209 - protein, 9 aa, synthetic construct
QQGYSSPFT

SEQ ID NO: 2210 - protein, 9 aa, synthetic construct
QQGDSSPFT

SEQ ID NO: 2211 - protein, 9 aa, synthetic construct
QQGYSSPFT

SEQ ID NO: 2212 - protein, 9 aa, synthetic construct
QQGYSSPFT

SEQ ID NO: 2213 - protein, 9 aa, synthetic construct
QQGYSSPFT

SEQ ID NO: 2214 - protein, 9 aa, synthetic construct
QQGYSSPFT

SEQ ID NO: 2215 - protein, 9 aa, synthetic construct
QQGYSSPFT

SEQ ID NO: 2216 - protein, 9 aa, synthetic construct
QQGYSSPFT

SEQ ID NO: 2217 - protein, 9 aa, synthetic construct
QQGDNTPFT

SEQ ID NO: 2218 - protein, 9 aa, synthetic construct
QQGDNTPFT

SEQ ID NO: 2219 - protein, 9 aa, synthetic construct
QQGHSTPFT

SEQ ID NO: 2220 - protein, 9 aa, synthetic construct
QQGHSTPFT

SEQ ID NO: 2221 - protein, 9 aa, synthetic construct
QQGYSSPFT

SEQ ID NO: 2222 - protein, 9 aa, synthetic construct
QQGYSSPFT

SEQ ID NO: 2223 - protein, 9 aa, synthetic construct
QQGHSTPFT

SEQ ID NO: 2224 - protein, 9 aa, synthetic construct
QQGHSTPFT

SEQ ID NO: 2225 - protein, 9 aa, synthetic construct
QQGDSTPFT

SEQ ID NO: 2226 - protein, 9 aa, synthetic construct
QQGDSTPFT

SEQ ID NO: 2227 - protein, 9 aa, synthetic construct
QQGHSTPFT

SEQ ID NO: 2228 - protein, 9 aa, synthetic construct
QQGHSTPFT

SEQ ID NO: 2229 - protein, 9 aa, synthetic construct
QQGDSTPFT

SEQ ID NO: 2230 - protein, 9 aa, synthetic construct
QQGDSTPFT

SEQ ID NO: 2231 - protein, 9 aa, synthetic construct
QQGYSSPFT

SEQ ID NO: 2232 - protein, 9 aa, synthetic construct
QQGYSSPFT

SEQ ID NO: 2233 - protein, 9 aa, synthetic construct
QQGHSTPFT

SEQ ID NO: 2234 - protein, 9 aa, synthetic construct
QQGHSTPFT

SEQ ID NO: 2235 - protein, 9 aa, synthetic construct
QQGDSTPFT

SEQ ID NO: 2236 - protein, 9 aa, synthetic construct
QQGDSTPFT

SEQ ID NO: 2237 - protein, 9 aa, synthetic construct
QQGDSTPFT

SEQ ID NO: 2238 - protein, 9 aa, synthetic construct
QQGYSSPFT

SEQ ID NO: 2239 - protein, 9 aa, synthetic construct
QQGYSSPFT

SEQ ID NO: 2240 - protein, 9 aa, synthetic construct
QQGYSTPFT

SEQ ID NO: 2241 - protein, 9 aa, synthetic construct
QQGYSTPFT

SEQ ID NO: 2242 - protein, 9 aa, synthetic construct
QQGDNTPFT

SEQ ID NO: 2243 - protein, 9 aa, synthetic construct
QQGDNTPFT

SEQ ID NO: 2244 - protein, 9 aa, synthetic construct
QQGYSTPFT

SEQ ID NO: 2245 - protein, 9 aa, synthetic construct
QQGYSTPFT

SEQ ID NO: 2246 - protein, 9 aa, synthetic construct
QQGDSTPFT

SEQ ID NO: 2247 - protein, 9 aa, synthetic construct
QQGDSTPFT

SEQ ID NO: 2248 - protein, 9 aa, synthetic construct
QQGHSTPFT

SEQ ID NO: 2249 - protein, 9 aa, synthetic construct
QQGHSTPFT

SEQ ID NO: 2250 - protein, 9 aa, synthetic construct
QQGYSSPFT

SEQ ID NO: 2251 - protein, 9 aa, synthetic construct
QQSYSTPFT

SEQ ID NO: 2252 - protein, 9 aa, synthetic construct
QQGYSTPFT

SEQ ID NO: 2253 - protein, 9 aa, synthetic construct
QQGDSTPFT

SEQ ID NO: 2254 - protein, 9 aa, synthetic construct
QQGYSSPFT

SEQ ID NO: 2255 - protein, 9 aa, synthetic construct
QQGDSSPFT

SEQ ID NO: 2256 - protein, 9 aa, synthetic construct
QQGYSTLFT

SEQ ID NO: 2257 - protein, 9 aa, synthetic construct
QQGYSSPFT

SEQ ID NO: 2258 - protein, 9 aa, synthetic construct
QQGYSNPFT

SEQ ID NO: 2259 - protein, 9 aa, synthetic construct
QQGFSTPFT

SEQ ID NO: 2260 - protein, 9 aa, synthetic construct
QQGYSSPFT

SEQ ID NO: 2261 - protein, 9 aa, synthetic construct
QQGYSSPFT

SEQ ID NO: 2262 - protein, 9 aa, synthetic construct
QQGDSTPFT

SEQ ID NO: 2263 - protein, 9 aa, synthetic construct
QQGDSTPFT

SEQ ID NO: 2264 - protein, 9 aa, synthetic construct
QQGHSTPFT

SEQ ID NO: 2265 - protein, 9 aa, synthetic construct
QQGHSTPFT

SEQ ID NO: 2266 - protein, 9 aa, synthetic construct
QQGHSTPIT

SEQ ID NO: 2267 - protein, 9 aa, synthetic construct
QQGYSSPFT

SEQ ID NO: 2268 - protein, 9 aa, synthetic construct
QQGYDTPFT

SEQ ID NO: 2269 - protein, 9 aa, synthetic construct
QQGDSTPFT

SEQ ID NO: 2270 - protein, 9 aa, synthetic construct
QQYGTSPIT

SEQ ID NO: 2271 - protein, 9 aa, synthetic construct
QQAKSFPLT

SEQ ID NO: 2272 - protein, 9 aa, synthetic construct
QQGYSSPFT

SEQ ID NO: 2273 - protein, 9 aa, synthetic construct
MQVTQFPIT

SEQ ID NO: 2274 - protein, 9 aa, synthetic construct
MQATQFPIT

SEQ ID NO: 2275 - protein, 118 aa, synthetic construct
EVQLVQSGAEVKKPGASVKVSCKASGYTFTGYYMHWVRQAPGQGLEWMGWINPKSGGTIYAQKFQGRVTMTRDTSISTAYMELSRLRSDDTAVYSCATGGSFDAFDIWGQGTMVTVSS

SEQ ID NO: 2276 - protein, 123 aa, synthetic construct
QVQLQQWGAGLLKPSETLSLTCAVYGGSFSGYYWSWIRQPPGKGLEWIGEITHSGITNYNPSLESRVTMSVDTSKNQFSLKLSSVTAADTAVYYCARGQVGTTDYYYFYMDVWGKGTLVTVSS

SEQ ID NO: 2277 - protein, 118 aa, synthetic construct
QVQLVQSGAEVKKPGASVKVSCKASGYTFTGYYMHWVRQAPGQGLEWMGWINPNSGGTNYAQNFQGRVTMTRDTSISTAYMELSRLRSDDTAVYYCAVGGSFDAFDIWGQGTMVTVSS

SEQ ID NO: 2278 - protein, 118 aa, synthetic construct
QVQLVQSGAEVKKPGASVKVSCKASGYTFTGYYMHWVRQAPGQGLEWMGWINPKSGGTNYAQNFQGRVTMTRDTSISTAYMELSRLRSDDTAVYYCAVGGSFDAFDIWGQGTMVTVSS

SEQ ID NO: 2279 - protein, 118 aa, synthetic construct
QVQLVQSGPEVEKPGASVKVSCKASGYTFTGYYMHWMRQAPGQGLEWMGWINPNSGGTNYAQKFQGRVTMTRDTSISTAYMDLSGLRSDDTAVYYCAVGGSFDAFDIWGQGTMVTVSS

SEQ ID NO: 2280 - protein, 118 aa, synthetic construct
QVQLVQSGAEVKKPGASVKVSCKASGYTFTAYYMHWVRQAPGQGLEWIGWINPNSGGTNYAQSFQGRVTMTRDTSITTAYMDLSRLRSDDTAIYYCATGGSFDAFDIWGQGTMVTVSS

SEQ ID NO: 2281 - protein, 118 aa, synthetic construct
QVQLVQSGAEVKKPGASVKVSCKASGYTFTAYYMHWVRQAPGQGLEWIGWINPKSGGTNYAQSFQGRVTMTRDTSITTAYMDLSRLRSDDTAIYYCATGGSFDAFDIWGQGTMVTVSS

SEQ ID NO: 2282 - protein, 118 aa, synthetic construct
QVQLVQSGAEVKEPGASVKVSCKASGYTFTAYYMHWVRQAPGQGLEWMGWINPNSGGTNYAQQFQGRVTMTRDTSISTAYMELSRLTSDDTAVYYCAVGGSYDAFDIWGQGTMVTVSS

SEQ ID NO: 2283 - protein, 118 aa, synthetic construct
QVQLVQSGAEVKEPGASVKVSCKASGYTFTAYYMHWVRQAPGQGLEWMGWINPKSGGTNYAQQFQGRVTMTRDTSISTAYMELSRLTSDDTAVYYCAVGGSYDAFDIWGQGTMVTVSS

SEQ ID NO: 2284 - protein, 118 aa, synthetic construct
EVQLVQSGVEVKKPGASVKVSCQASGYTFTAYYIHWVRQAPGQGLEWMGWINPNSGGTNYAQKFQGRVTMTRDSSISTAYMELSRLRSDDTAVYYCAVGGSFDAFDIWGQGTMVTVSS

SEQ ID NO: 2285 - protein, 118 aa, synthetic construct
EVQLVQSGVEVKKPGASVKVSCQASGYTFTAYYIHWVRQAPGQGLEWMGWINPKSGGTNYAQKFQGRVTMTRDSSISTAYMELSRLRSDDTAVYYCAVGGSFDAFDIWGQGTMVTVSS

SEQ ID NO: 2286 - protein, 118 aa, synthetic construct
EVQLVQSGAEVKKPGASVKVSCKASGYTFTGYYLHWVRQAPGQGLEWMGWINPNSGGTNFAQKFQGRVTMTRDTSINTAYMELSRLRSDDTAVYYCAVGGSYDAFDIWGQGTMVTVSS

SEQ ID NO: 2287 - protein, 118 aa, synthetic construct
EVQLVQSGAEVKKPGASVKVSCKASGYTFTGYYLHWVRQAPGQGLEWMGWINPKSGGTNFAQKFQGRVTMTRDTSINTAYMELSRLRSDDTAVYYCAVGGSYDAFDIWGQGTMVTVSS

SEQ ID NO: 2288 - protein, 118 aa, synthetic construct
EVQLVQSGAEVKKPGASVKVSCKASGYTFTGYYMHWVRQAPGQGLEWMGWINPNSGGTNYAQKFQGRVTMTRDTSISTAYMELSGLRSDDTAVYYCAVGGSYDAFDIWGQGTMVTVSS

SEQ ID NO: 2289 - protein, 118 aa, synthetic construct
EVQLVQSGAEVKKPGASVKVSCKASGYTFTGYYMHWVRQAPGQGLEWMGWINPKSGGTNYAQKFQGRVTMTRDTSISTAYMELSGLRSDDTAVYYCAVGGSYDAFDIWGQGTMVTVSS

SEQ ID NO: 2290 - protein, 118 aa, synthetic construct
QVQLVQSGAEVKKPGASVKFSCKASGYTFTGYYLHWVRQAPGQGLEWMGWINPNSGGTNYAQRFQGRVTMTRDTSINTAYMELSRLRSDDTAVYYCATGGSFDAFDIWGQGTMVTVSS

SEQ ID NO: 2291 - protein, 118 aa, synthetic construct
QVQLVQSGAEVKKPGASVKFSCKASGYTFTGYYLHWVRQAPGQGLEWMGWINPKSGGTNYAQRFQGRVTMTRDTSINTAYMELSRLRSDDTAVYYCATGGSFDAFDIWGQGTMVTVSS

SEQ ID NO: 2292 - protein, 118 aa, synthetic construct; identical to SEQ ID NO: 2275

SEQ ID NO: 2293 - protein, 118 aa, synthetic construct
EVQLVESGAEVKKPGASVKVSCKASGYTFTGYYMHWVRQAPGQGLEWMGWINPKSGGTNYAQKFQGRVTMTRDTSISTAYMELSRLRSDDTAVYYCATGGSFDAFDIWGQGTMVTVSS

SEQ ID NO: 2294 - protein, 118 aa, synthetic construct
EVQLVQSGAEVKKPGASVKVSCKASGYTFTGYYMHWVRQAPGQGLEWMGWINPKSGGTSYAQKFQGRVTMTRDTSISTAYMELSRLRSDDTAVYYCAVGGSYDAFDIWGQGTMVTVSS

SEQ ID NO: 2295 - protein, 118 aa, synthetic construct
EVQLVESGAEVKKPGASVKVSCKASGYTFTGYYMHWVRQAPGQGLEWMGWINPKSGGTNYAQKFQGRVTMTRDTSISTAYMELSRLRSDDTAVYYCAVGGSYDAFDIWGQGTMVTVSS

SEQ ID NO: 2296 - protein, 118 aa, synthetic construct
EVQLVQSGAEVRKPGASVKVSCKASGYTFTAYYIHWVRQAPGQGLEWMGWINPNSGGTNYAQNFQGRVTMTRDTSISTAYMELSRLRPDDTAVYFCAVGGSFDAFDIWGQGTMVTVSS

SEQ ID NO: 2297 - protein, 118 aa, synthetic construct
EVQLVQSGAEVRKPGASVKVSCKASGYTFTAYYIHWVRQAPGQGLEWMGWINPKSGGTNYAQNFQGRVTMTRDTSISTAYMELSRLRPDDTAVYFCAVGGSFDAFDIWGQGTMVTVSS

SEQ ID NO: 2298 - protein, 118 aa, synthetic construct
QVQLVQSGAEVKRPGAAVKVSCKASGYTFTGYYMHWVRQAPGQGLEWMGWINPKSGGTNYAQNFQGRVTMTRDTSISTAYMELSRLTSDDTAMYYCATGGSFDAFDIWGQGTMVTVSS

SEQ ID NO: 2299 - protein, 118 aa, synthetic construct
EVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAVGGSYDAFDIWGQGTMVTVSS

SEQ ID NO: 2300 - protein, 118 aa, synthetic construct
EVQLVQSGAEVKKPGASVKVSCKASGYTFTGYYMHWVRQAPGQGLEWMGWINPKSGGTNYAQKFQGRVTMTRDTSISTAYMELSRLRSDDTAVYYCAVGGSYDAFDIWGQGTMVTVSS

SEQ ID NO: 2301 - protein, 118 aa, synthetic construct
EVQLVQSGAEVKSPGASVKVSCKASGYTFTAYYMHWVRQAPGQGLEWMGWINPNSGGTKYAQKFQGRVTVTRDTSISTAYMELNRLTSDDTAVYYCAVGGSYDAFDIWGQGTMVTVSS

SEQ ID NO: 2302 - protein, 118 aa, synthetic construct
EVQLVQSGAEVKSPGASVKVSCKASGYTFTAYYMHWVRQAPGQGLEWMGWINPKSGGTKYAQKFQGRVTVTRDTSISTAYMELNRLTSDDTAVYYCAVGGSYDAFDIWGQGTMVTVSS

SEQ ID NO: 2303 - protein, 118 aa, synthetic construct
EVQLVQSGAEVKKPGASVKVSCKASGYTFTAYYLHWVRQAPGQGLEWMGWINPNSGGTNYAQKFQGRVTMTRDTSISTAYMELSRLRSDDTAVYYCASGGSFDAFDIWGQGTMVTVSS

SEQ ID NO: 2304 - protein, 118 aa, synthetic construct
EVQLVQSGAEVKKPGASVKVSCKASGYTFTAYYLHWVRQAPGQGLEWMGWINPKSGGTNYAQKFQGRVTMTRDTSISTAYMELSRLRSDDTAVYYCASGGSFDAFDIWGQGTMVTVSS

SEQ ID NO: 2305 - protein, 118 aa, synthetic construct
QVQLVESGAEVKKPGASVKVSCKASGYTFTGYFIHWVRQAPGQGLEWMGWINPKSGGTNYAQKFQDRVTMTRDTSISTAYMELSRLRSDDTAVYYCAVGGSYDAFDIWGQGTMVTVSS

SEQ ID NO: 2306 - protein, 118 aa, synthetic construct
QVQLVQSGAEVKSPGASVKVSCKASGYTFTAYYMHWVRQAPGQGLEWMGWINPNSGGTKYAQKFQGRVTVTRDTSISTAYMELNRLTSDDTAVYYCAVGGSYDAFDIWGQGTMVTVSS

SEQ ID NO: 2307 - protein, 118 aa, synthetic construct
QVQLVQSGAEVKSPGASVKVSCKASGYTFTAYYMHWVRQAPGQGLEWMGWINPKSGGTKYAQKFQGRVTVTRDTSISTAYMELNRLTSDDTAVYYCAVGGSYDAFDIWGQGTMVTVSS

SEQ ID NO: 2308 - protein, 118 aa, synthetic construct
QVQLVQSGAEVKKPGASVRVSCKASGYTFTAYYIHWVRQAPGQGLEWMGWINPNSGGTSSAQKFQGRVTMTRDTSISTAYMDLSRLRSDDTAVYYCAVGGSFDAFDIWGQGTMVTVSS

SEQ ID NO: 2309 - protein, 118 aa, synthetic construct
QVQLVQSGAEVKKPGASVRVSCKASGYTFTAYYIHWVRQAPGQGLEWMGWINPKSGGTSSAQKFQGRVTMTRDTSISTAYMDLSRLRSDDTAVYYCAVGGSFDAFDIWGQGTMVTVSS

SEQ ID NO: 2310 - protein, 118 aa, synthetic construct
EVQLVQSGAEVKKPGASVKVSCKASGYTFTAYYIHWVRQAPGQGLEWMGWVNPNSGGTNYAQSFQGRVTMTGDTSITTAYMDLSELRSDDTAVYYCAVGGSFDAFDIWGQGTMVTVSS

SEQ ID NO: 2311 - protein, 118 aa, synthetic construct
EVQLVQSGAEVKKPGASVKVSCKASGYTFTAYYIHWVRQAPGQGLEWMGWVNPKSGGTNYAQSFQGRVTMTGDTSITTAYMDLSELRSDDTAVYYCAVGGSFDAFDIWGQGTMVTVSS

SEQ ID NO: 2312 - protein, 118 aa, synthetic construct
QVQLVQSGAEVKSPGASVKVSCKASGYTFTAYYMHWVRQAPGQGLEWMGWINPNSGGTKYAQKFQGRVTVTRDTSISTAYMELNRLTSDDTAVYYCATGGSFDAFDIWGQGTMVTVSS

SEQ ID NO: 2313 - protein, 118 aa, synthetic construct
QVQLVQSGAEVKSPGASVKVSCKASGYTFTAYYMHWVRQAPGQGLEWMGWINPKSGGTKYAQKFQGRVTVTRDTSISTAYMELNRLTSDDTAVYYCATGGSFDAFDIWGQGTMVTVSS

SEQ ID NO: 2314 - protein, 118 aa, synthetic construct
EVQLVQSGAEVKKPGASVKVSCKASGYTFTGYYIHWVRQAPGQGLEWMGWINPKSGGTNYAQKFQGRVTMTRDTSISTAYMELSRLRSDDTAVYYCAVGGSYDAFDIWGQGTMVTVSS

SEQ ID NO: 2315 - protein, 118 aa, synthetic construct; identical to SEQ ID NO: 2299

SEQ ID NO: 2316 - protein, 118 aa, synthetic construct; identical to SEQ ID NO: 2300

SEQ ID NO: 2317 - protein, 118 aa, synthetic construct
QVQLVQSGAEVKKPGASVKVSCKASGYTFTGYYMHWVRQAPGQGLEWMGWIHPNSGGTNSAQKFQGRVTMTRDTSISTAYMELSRLRSDDTAVYYCAVGGSYDAFDIWGQGTMVTVSS

SEQ ID NO: 2318 - protein, 118 aa, synthetic construct
QVQLVQSGAEVKKPGASVKVSCKASGYTFTGYYMHWVRQAPGQGLEWMGWIHPKSGGTNTAQKFQGRVTMTRDTSISTAYMELSRLRSDDTAVYYCAVGGSYDAFDIWGQGTMVTVSS

SEQ ID NO: 2319 - protein, 118 aa, synthetic construct
QVQLVQSGAEVKKPGASVKVSCKASGYTFTGYFIHWVRQAPGQGLEWMGWINPKSGGTNYAQKFQGRVTMTRDTSISTAYMELSRLSSDDTAVYYCASGGSFDAFDIWGQGTMVTVSS

SEQ ID NO: 2320 - protein, 118 aa, synthetic construct
QVQLVQAGAEVKKPGASVKVSCKASGYTFTGYYMHWVRQAPGQGLEWMGWINPNSGGTNYAQKFQGRVTMTRDTSISTAYMELSRLRSDDTAVYYCATGGSFDAFDIWGQGTMVTVSS

SEQ ID NO: 2321 - protein, 118 aa, synthetic construct
QVQLVQAGAEVKKPGASVKVSCKASGYTFTGYYMHWVRQAPGQGLEWMGWINPKSGGTNYAQKFQGRVTMTRDTSISTAYMELSRLRSDDTAVYYCATGGSFDAFDIWGQGTMVTVSS

SEQ ID NO: 2322 - protein, 118 aa, synthetic construct
EVQLVQSGAEVKNPGASVKVSCKASGYTFTGYYMHWVRQAPGQGLEWMGWINPNSGGPNYAQKFQDRVTMTRDTSISTAYMELSRLRSDDTAVYYCATGGSFDAFDIWGQGTMVTVSS

SEQ ID NO: 2323 - protein, 118 aa, synthetic construct
EVQLVQSGAEVKNPGASVKVSCKASGYTFTGYYMHWVRQAPGQGLEWMGWINPKSGGPNYAQKFQDRVTMTRDTSISTAYMELSRLRSDDTAVYYCATGGSFDAFDIWGQGTMVTVSS

SEQ ID NO: 2324 - protein, 118 aa, synthetic construct
EVQLVESGAEVKKPGASVKVSCKASGYTFTGYFMHWVRQAPGQGLEWMGWINPNSGGTNYAQRFQGRVTMTRDTSINTAYMELSRLRSDDTAVYYCATGGSFDAFDIWGQGTMVTVSS

SEQ ID NO: 2325 - protein, 118 aa, synthetic construct
EVQLVESGAEVKKPGASVKVSCKASGYTFTGYFMHWVRQAPGQGLEWMGWINPKSGGTNYAQRFQGRVTMTRDTSINTAYMELSRLRSDDTAVYYCATGGSFDAFDIWGQGTMVTVSS

SEQ ID NO: 2326 - protein, 118 aa, synthetic construct
EVQLVQSGAEVKKPGASVNVSCKASGYTFTGYYMHWVRQAPGQGLEWMGWINPNSGGTNYAQKFQGRVTMTRDTSISTAYMELSRLISDDTAVYYCATGGSFDAFDVWGQGTMVTVSS

SEQ ID NO: 2327 - protein, 118 aa, synthetic construct
EVQLVQSGAEVKKPGASVKVSCKASGYTFTGYYMHWVRQAPGQGLEWMGWINPKSGGTNYAQKFQGRVTMTRDTSISTAYMELSRLISDDTAVYYCATGGSFDAFDVWGQGTMVTVSS

SEQ ID NO: 2328 - protein, 118 aa, synthetic construct
QVQLVQSGAEVKKPGASVKVSCKASGYTFTGYYMQWVRQAPGQGLEWMGWINPNSGGTIYAQKFQGRVTMTRDTSISTAYMELSRLRSDDTAVYSCATGGSFDAFDIWGQGTMVTVSS

SEQ ID NO: 2329 - protein, 118 aa, synthetic construct
QVQLVQSGAEVKKPGASVKVSCKASGYTFTGYYMQWVRQAPGQGLEWMGWINPKSGGTIYAQKFQGRVTMTRDTSISTAYMELSRLRSDDTAVYSCATGGSFDAFDIWGQGTMVTVSS

SEQ ID NO: 2330 - protein, 118 aa, synthetic construct
EVQLVESGAEVKNPGASVKVSCKASGYTFTGYYLHWVRQAPGQGLEWMGWIKPNSGGTNYAQKFQGRVTMTRDTSISTAYMELSRLRSDDTAVYYCAVGGSYDAFDIWGQGTMVTVSS

SEQ ID NO: 2331 - protein, 118 aa, synthetic construct
EVQLVESGAEVKNPGASVKVSCKASGYTFTGYYLHWVRQAPGQGLEWMGWIKPKSGGTNYAQKFQGRVTMTRDTSISTAYMELSRLRSDDTAVYYCAVGGSYDAFDIWGQGTMVTVSS

SEQ ID NO: 2332 - protein, 118 aa, synthetic construct
QVQLVQSGAEVKKPGASVKVSCKASGYTFTAYYMHWVRQAPGQGLEWMGWVNPNSGGTNYAQNFQGRVTMTGDTSITTAYMDLSGLRSDDTAVYYCAVGGSFDAFDIWGQGTMVTVSS

SEQ ID NO: 2333 - protein, 118 aa, synthetic construct
QVQLVQSGAEVKKPGASVKVSCKASGYTFTAYYMHWVRQAPGQGLEWMGWVNPKSGGTNYAQNFQGRVTMTGDTSITTAYMDLSGLRSDDTAVYYCAVGGSFDAFDIWGQGTMVTVSS

SEQ ID NO: 2334 - protein, 118 aa, synthetic construct
QVQLVQSGAEVKKPGASVKVSCKASGYTFTGYYMHWVRQAPGQGLEWMGWINPNSGGTNYAQKFQGRVTMTRDTSISTAYMELSRLISDDTAVYYCATGGSFDAFDIWGQGTMVTVSS

SEQ ID NO: 2335 - protein, 118 aa, synthetic construct
QVQLVQSGAEVKKPGASVKVSCKASGYTFTGYYMHWVRQAPGQGLEWMGWINPKSGGTNYAQKFQGRVTMTRDTSISTAYMELSRLISDDTAVYYCATGGSFDAFDIWGQGTMVTVSS

SEQ ID NO: 2336 - protein, 118 aa, synthetic construct
QVQLVQSGAEVKKPGASMKVSCKASGYTFTGYYMHWVRQAPGQGLEWMGWINPNSGGTNYAQRFQGRVTMTRDTSVSTAYMDLSRLRSDDTAVYYCATGGSFDAFDIWGQGTMVTVSS

SEQ ID NO: 2337 - protein, 118 aa, synthetic construct
QVQLVQSGAEVKKPGASMKVSCKASGYTFTGYYMHWVRQAPGQGLEWMGWINPKSGGTNYAQRFQGRVTMTRDTSVSTAYMDLSRLRSDDTAVYYCATGGSFDAFDIWGQGTMVTVSS

SEQ ID NO: 2338 - protein, 118 aa, synthetic construct
EVQLVESGAEVKKPGASVKVSCKASGYTFTGYYMHWVRQAPGQGLEWMGWIKPNSGGTNYAQKFQGRVTMTRDTSISTAYMELSRLRSDDTAVYYCAVGGSYDAFDIWGQGTMVTVSS

SEQ ID NO: 2339 - protein, 118 aa, synthetic construct
EVQLVESGAEVKKPGASVKVSCKASGYTFTGYYMHWVRQAPGQGLEWMGWIKPKSGGTNYAQKFQGRVTMTRDTSISTAYMELSRLRSDDTAVYYCAVGGSYDAFDIWGQGTMVTVSS

SEQ ID NO: 2340 - protein, 118 aa, synthetic construct
EVQLVESGAEVKKPGASVKVSCKASGYTFTGYYIHWVRQAPGQGLEWMGWINPNSGGTNYAQKFQGRVTMTRDTSISTAYMDLSRLRSDDTAVYYCATGGSFDAFDIWGQGTMVTVSS

SEQ ID NO: 2341 - protein, 118 aa, synthetic construct
EVQLVESGAEVKKPGASVKVSCKASGYTFTGYYIHWVRQAPGQGLEWMGWINPKSGGTNYAQKFQGRVTMTRDTSISTAYMDLSRLRSDDTAVYYCATGGSFDAFDIWGQGTMVTVSS

SEQ ID NO: 2342 - protein, 118 aa, synthetic construct; identical to SEQ ID NO: 2301

SEQ ID NO: 2343 - protein, 118 aa, synthetic construct; identical to SEQ ID NO: 2302

SEQ ID NO: 2344 - protein, 118 aa, synthetic construct
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCATGGSFDAFDIWGQGTMVTVSS

SEQ ID NO: 2345 - protein, 118 aa, synthetic construct
EVQLVQSGAEVKKPGAPVKVSCKASGYTFTGYYMHWVRQAPGQGLEWMGWINPNSGGTNYAQKFQGRVTMTRDTSISTAYMELSRLRSDDTAVYYCAVGGSYDAFDIWGQGTMVTVSS

SEQ ID NO: 2346 - protein, 118 aa, synthetic construct
EVQLVQSGAEVKKPGAPVKVSCKASGYTFTGYYMHWVRQAPGQGLEWMGWINPKSGGTNYAQKFQGRVTMTRDTSISTAYMELSRLRSDDTAVYYCAVGGSYDAFDIWGQGTMVTVSS

SEQ ID NO: 2347 - protein, 118 aa, synthetic construct
EVQLVQSGAEVKKPGASVKVSCKASGYTFTGYYMHWVRQAPGQGLEWMGWINPNSGATNFAQKFQGRVTMTRDTSITTAYMELSRLRSDDTAVYYCATGGSFDAFDIWGQGTMVTVSS

SEQ ID NO: 2348 - protein, 118 aa, synthetic construct
EVQLVQSGAEVKKPGASVKVSCKASGYTFTGYYMHWVRQAPGQGLEWMGWINPKSGATNFAQKFQGRVTMTRDTSITTAYMELSRLRSDDTAVYYCATGGSFDAFDIWGQGTMVTVSS

SEQ ID NO: 2349 - protein, 118 aa, synthetic construct
QVQLVQSGAEVKRPGASVKVSCKASGYTFTAYYLHWVRQAPGQGLEWMGWINPNSGGTNYAQKFQDRVTMTGDTSISTAYMELSRLRSDDTAVYYCAVGGSYDAFDIWGQGTMVTVSS

SEQ ID NO: 2350 - protein, 118 aa, synthetic construct
QVQLVQSGAEVKRPGASVKVSCKASGYTFTAYYLHWVRQAPGQGLEWMGWINPKSGGTNYAQKFQDRVTMTGDTSISTAYMELSRLRSDDTAVYYCAVGGSYDAFDIWGQGTMVTVSS

SEQ ID NO: 2351 - protein, 118 aa, synthetic construct; identical to SEQ ID NO: 2306

SEQ ID NO: 2352 - protein, 118 aa, synthetic construct; identical to SEQ ID NO: 2307

SEQ ID NO: 2353 - protein, 118 aa, synthetic construct
QVQLVQSGAEVKKPGASVKVSCKASGYTFTGYYMHWVRQAPGQGLEWMGWINPKSGGTNYAQKFQGRVTMTRDTSISTAYMELSRLRSDDTAVYYCATGGSYDAFDIWGQGTMVTVSS

SEQ ID NO: 2354 - protein, 118 aa, synthetic construct; identical to SEQ ID NO: 2353

SEQ ID NO: 2355 - protein, 118 aa, synthetic construct
EVQLVQSGAEVKKPGASVKVSCKTSGYTFTAYYLHWVRQAPGQGLEWMGWINPNSGGTSSAQKFQGRVTMTRDTSISTAYMDLTRLRSDDTAVYYCAVGGSFDAFDIWGQGTMVTVSS

SEQ ID NO: 2356 - protein, 118 aa, synthetic construct
EVQLVQSGAEVKKPGASVKVSCKTSGYTFTAYYLHWVRQAPGQGLEWMGWINPKSGGTSSAQKFQGRVTMTRDTSISTAYMDLTRLRSDDTAVYYCAVGGSFDAFDIWGQGTMVTVSS

SEQ ID NO: 2357 - protein, 118 aa, synthetic construct
QVQLVQSGAEVKKPGASVKVSCKASGYTFTGYYMHWVRQAPGQGLEWMGWINPNSGGTHYAQKFQGRVTMTRDTSISTAYMELSRLRSDDTAVYFCAVGGSFDAFDIWGQGTMVTVSS

SEQ ID NO: 2358 - protein, 118 aa, synthetic construct
QVQLVQSGAEVKKPGASVKVSCKASGYTFTGYYMHWVRQAPGQGLEWMGWINPKSGGTHYAQKFQGRVTMTRDTSISTAYMELSRLRSDDTAVYFCAVGGSFDAFDIWGQGTMVTVSS

SEQ ID NO: 2359 - protein, 118 aa, synthetic construct
EVQLVQSGAEVKKPGASVKVSCKASGYTFTGYYIHWVRQAPGQGLEWMGWINPNSGGTNYAQRFQGRVTMTRDTSISTAYMDLSRLRSDDTAVYYCATGGSFDAFDIWGQGTMVTVSS

SEQ ID NO: 2360 - protein, 118 aa, synthetic construct
QVQLVQSGAEVKKPGASVKVSCKASGYTFTGYYMHWVRQAPGQGLEWMGWINPKSGGTIYAQKFQGRVTMTRDTSISTAYMELSRLRSDDTAVYSCATGGSFDAFDIWGQGTMVTVSS

SEQ ID NO: 2361 - protein, 118 aa, synthetic construct
QVQLVQSGAEVKRPGASLTVSCKSSGYTFTAYYIHWVRQAPGQGLEWMGWINPNSGGTNYAQKFQGRVTMTRDTSITTAYMELSRLRSDDTAVYYCAVGGSYDAFDIWGQGTMVTVSS

SEQ ID NO: 2362 - protein, 118 aa, synthetic construct
QVQLVQSGAEVKKPGASVKVSCKASGYTFTGYFMHWVRQAPGQGLEWMGWINPKSGGTNYAQKFQGRVTMTRDTSISTAYMELSRLRFDDTAVYYCASGGSFDAFDIWGQGTMVTVSS

SEQ ID NO: 2363 - protein, 118 aa, synthetic construct
EVQLVESGAEVKKPGASVKVSCKASGYTFTGYYMHWVRQAPGRGLEWMGWINPNSGGTKYAQKFQGRVTMTRDTSINTAYMELSRLRPDDTAVYYCATGGSFDAFDIWGQGTMVTVSS

SEQ ID NO: 2364 - protein, 118 aa, synthetic construct
EVQLVESGAEVKKPGASVKVSCKASGYTFTGYYMHWVRQAPGQGLEWMGWINPNSGGTNYAQKFQGRVTMTRDTSISTAYMELSRLRSDDTAVYYCASGGSFDAFDIWGQGTMVTVSS

SEQ ID NO: 2365 - protein, 118 aa, synthetic construct
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAVGGSYDAFDIWGQGTMVTVSS

SEQ ID NO: 2366 - protein, 118 aa, synthetic construct
EVQLVQSGAEVKKPGASVKVSCKASGYTFNGYYMHWIRQAPGQGLEWMGWINPNSGGTKYSQKFQGRVTMTRDTSISTAYMELSRLRSDDTAVYYCATGGSFDAFDIWGQGTMVTVSS

SEQ ID NO: 2367 - protein, 118 aa, synthetic construct; identical to SEQ ID NO: 2299

SEQ ID NO: 2368 - protein, 118 aa, synthetic construct
EVQLVESGAEVKKPGASVKVSCKASGYTFTAYYMHWVRQAPGQGLEWMGWINPNSGGTNYAQKFQGRVTMTRDTSINTAYMELSRLRSDDTAVYYCASGGSIDAFDIWGQGTMVTVSS

SEQ ID NO: 2369 - protein, 118 aa, synthetic construct
QVQLVQSEAEVKKPGASVKVSCKASGYTFTAYYIHWVRQAPGQGLEWMGWINPNSGGTNYAQKFQDRVTMTGDTSISTAYMELRRLRSDDTAVYYCAVGGSYDAFDIWGQGTMVTVSS

SEQ ID NO: 2370 - protein, 118 aa, synthetic construct
EVQLVQSGAEVKKPGASMKVSCKASGYTFTGYYIHWVRQAPGQGLEWMGWINPNSGGTKYAQKFHGRVTLTRDTSVNTAYMDLSGLRSDDTAVYYCAVGGSFDAFDIWGQGTMVTVSS

SEQ ID NO: 2371 - protein, 118 aa, synthetic construct
EVQLVQSGAEVKKPGASVKVSCKASGYTFTGYYMHWVRQAPGQGLEWMGWINPNSGGTNYAQKFQGRVTMTRDTSISTAYMELSRLISDDTAVYYCVTGGSFDAFDVWGQGTMVTVSS

SEQ ID NO: 2372 - protein, 118 aa, synthetic construct
QVQLVQSGAEVKKPGASVRVSCKASGYTFTGYYMHWVRQAPGQGLEWMGWINPNSGGTNYAQKFQGRVTVTRDTSISTAYMELSRLRSDDTAVYYCTSGGSFDAFDIWGQGTMVTVSS

SEQ ID NO: 2373 - protein, 118 aa, synthetic construct
EVQLVQSGAEVKRPGASLTVSCKSSGYTFTAYYIHWVRQAPGQGLEWMGWINPNSGGTNYAQRFQGRVTMTRDTSISTAYMELSRLRSDDTAVYYCATGGSFDAFDIWGQGTMVTVSS

SEQ ID NO: 2374 - protein, 118 aa, synthetic construct
EVQLVQSGAEVKKPGASVKVSCKASGYTFTGYYMHWVRQAPGQGLEWMGWINPKSGGTNYAQKFQGRVTMTRDTSISTAYMELSRLRSDDTAVYYCASGGSFDAFDIWGQGTMVTVSS

SEQ ID NO: 2375 - protein, 118 aa, synthetic construct
EVQLVESGAEVKKPGASVRVSCKASGYTFTAYYIHWVRQAPGQGLEWMGWINPNSGGTSSAQKFQGRVTMTRDTSISTAYMDLNRLRSDDTAMYYCAVGGSFDAFDIWGQGTMVTVSS

SEQ ID NO: 2376 - protein, 118 aa, synthetic construct
EVQLVQSGAEVKRPGASVKVSCKASGYTFTGYYMHWVRQAPGQGLEWMGWINPNSGGTNYAQKFQGRVTMTRDTSISTAYLELSRLRSDDTAVYYCATGGSYDAFDIWGQGTMVTVSS

SEQ ID NO: 2377 - protein, 118 aa, synthetic construct
QVQLVQSGAEVKKPGASVKVSCKASGYTFTGYYMHWVRQAPGQGLEWMGWINPNSGGTKYAQKFQGRVTMTRDTSISTAYMELSSLRSDDTAVYYCATGGSYDAFDIWGQGTMVTVSS

SEQ ID NO: 2378 - protein, 118 aa, synthetic construct; identical to SEQ ID NO: 2293

SEQ ID NO: 2379 - protein, 118 aa, synthetic construct
QVQLVQSGSDLKKPGASVKVSCKASGYTFTRYGMNWVRQAPGQGLEWMGWINTNTGNPTYAQDFTGRFVFSLDTSVSTAYLQISSLKAEDTAVYYCARDNWNYVSDYWGQGTLVTVSS

SEQ ID NO: 2380 - protein, 118 aa, synthetic construct; identical to SEQ ID NO: 2275

SEQ ID NO: 2381 - protein, 118 aa, synthetic construct
EVQLVESGAEVKKPGASVKVSCKASGYTFTVYYMHWVRQAPGQGLEWMGWINPNSGGTNYAQKFQGRVTMTRDTSISTAYMELSRLRSDDTAVYYCASGGSFDAFDIWGQGTMVTVSS

SEQ ID NO: 2382 - protein, 118 aa, synthetic construct
QVQLVQSGSELQKPGASVKVSCKTSGYTFTRYGMNWVRQAPGQGLEWMGWINTNTGNPTYAQGFTGRFVFSLDTSVSTAYLQISSLKAEDTAVYYCARDNWNYDFDYWGQGTTVTVSS

SEQ ID NO: 2383 - protein, 118 aa, synthetic construct
QVQLVQSGSELKRPGASVKVSCKASGYTFTTYGMNWVRQAPGQGLEWMGWINTNTGNPTYAQGFTGRFVFSLDTSVSTAYLQISSLKAEDTAVYYCARDNWNYDLDYWGQGTLVTVSS

SEQ ID NO: 2384 - protein, 107 aa, synthetic construct
DIQMTQSPSSLSASVGDRVTITCRASQSISRYLYWYQQKPGKAPKLLIYGASSLQSGVPSRFSGSGSGTDFTLTVSSMQPEDFATYYCQQGFSAPLTFGGGTKVDIK

SEQ ID NO: 2385 - protein, 106 aa, synthetic construct
DIQMTQSPSSLSASVGDRVTITCRASQSIRRYLNWYQQKPGKAPKLLIYAASSLQSGVPSRFSGSGSGTDFTLTISSLQPEDFASYFCQQSYRTITFGQGTKLEIK

SEQ ID NO: 2386 - protein, 107 aa, synthetic construct
DIQLTQSPSSLSASVGDRVTITCRASQSISRYLNWYQQKPGKAPKILIYGASSVQSGVPSRFSGSGSGTDFTLAISSLQPEDFATYYCQQGDSSPFTFGPGTKVDIK

SEQ ID NO: 2387 - protein, 107 aa, synthetic construct; identical to SEQ ID NO: 2386

SEQ ID NO: 2388 - protein, 107 aa, synthetic construct
DIVMTQSPSSLSASVGDRVTITCRASQSISSYLNWYQQKPGKAPKFLIYGASSLQSGVPSRFSGSGSGTDFTLTISSLQPEDFATYYCQQGHSTPFTFGPGTKVEIK

SEQ ID NO: 2389 - protein, 107 aa, synthetic construct
DIVMTQSPSSLSASVGDRVTITCRASQSISRYLNWYQQKPGKAPKILIYGASSVQSGVPSRFSGSGSGTDFTLAISSLQPEDFATYYCQQGDSSPFTFGPGTKVEIK

SEQ ID NO: 2390 - protein, 107 aa, synthetic construct; identical to SEQ ID NO: 2389

SEQ ID NO: 2391 - protein, 107 aa, synthetic construct
DIQMTQSPSSLSASVGDRVTITCRASQSISSYLNWYQQKPGKAPKFLIYGASRLQSGVPSRFSGSGSGTDFTLSISSLQPEDFATYYCQQGHSTPFTFGPGTKLEIK

SEQ ID NO: 2392 - protein, 107 aa, synthetic construct; identical to SEQ ID NO: 2391

SEQ ID NO: 2393 - protein, 107 aa, synthetic construct
DIQMTQSPSSLSASVGDRVTITCRASQSISSYLNWYQQKPGKAPKILIYGASSLQSGVPSRFSGSGSGTDFTLAISSLQPEDFATYYCQQGDSTPFTFGPGTKVDIK

SEQ ID NO: 2394 - protein, 107 aa, synthetic construct; identical to SEQ ID NO: 2393

SEQ ID NO: 2395 - protein, 107 aa, synthetic construct
DIQMTQSPSSLSASVGDRVTITCRASQSISSYLNWYQQKPGKVPKILIYGASRLQSGVPSRFSGSGSGTDFTLAISSLQPEDFATYYCQQGDSTPFTFGPGTKVDIK

SEQ ID NO: 2396 - protein, 107 aa, synthetic construct; identical to SEQ ID NO: 2395

SEQ ID NO: 2397 - protein, 107 aa, synthetic construct
DIVMTQSPSSLSASVGDRVTITCRASQSISSYLNWYQEKPGKAPKILIYGASRLQSGVPSRFSGSGSGTDFTLAISSLQPEDFATYYCQQGDSTPFTFGPGTKVEIK

SEQ ID NO: 2398 - protein, 107 aa, synthetic construct; identical to SEQ ID NO: 2397

SEQ ID NO: 2399 - protein, 107 aa, synthetic construct
DIQMTQSPSSLSASVGDRVTITCRASQSISSYLNWYQQSPGKAPKILIYGASRLQSGVPSRFSGSGSGTDFTLAISSLQPEDFATYYCQQGDSSPFTFGPGTKVEIK

SEQ ID NO: 2400 - protein, 107 aa, synthetic construct; identical to SEQ ID NO: 2399

SEQ ID NO: 2401 - protein, 107 aa, synthetic construct
DIVLTQSPSSLSASVGDRVTITCRASQSISSYLNWYQQKPGKAPKFLIYGASSLQSGVPSRFSGSGSGTDFTLTISSLQPEDFATYYCQQGHSTPFTFGPGTKVDIK

SEQ ID NO: 2402 - protein, 107 aa, synthetic construct
DIQMTQSPSSLSASVGDRVTITCRASQSISSYLNWYQQKPGKAPKILIYGASSLQSGVPSRFSGSGSGTDFTLAISSLQPEDFATYYCQQGDSTPFTFGPGTKLEIK

SEQ ID NO: 2403 - protein, 107 aa, synthetic construct
DIQMTQSPSSLSASVGDRVTITCRASQSISSYLNWYQQKPGKAPKFLIYGASSLQSGVPSRFSGSGSGTDFTLTISSLQPEDFATYYCQQGHSTPFTFGPGTKLEIK

SEQ ID NO: 2404 - protein, 107 aa, synthetic construct
DIQMTQSPSSLSASVGDRVTITCRASQSISSYLNWYQQKPGKAPKFLIYGASRLQSGVPSRFSGSGSGTDFTLTISSLQPEDFATYYCQQGYSSPFTFGPGTKVEIK

SEQ ID NO: 2405 - protein, 107 aa, synthetic construct
DIQLTQSPSSLSASVGDRVTITCQASQDISNYLNWYQQKPGKAPKILIYGASSLQSGVPSRFSGSGSGTDFTLAISSLQPEDYATYYCQQGDSTPFTFGPGTKVEIK

SEQ ID NO: 2406 - protein, 107 aa, synthetic construct; identical to SEQ ID NO: 2405

SEQ ID NO: 2407 - protein, 107 aa, synthetic construct
DIQMTQSPSSVSASVGDRVTITCRASQGISRYLHWYQQKPGKAPNFLIYGASSLQSGVPSRFSGSGSGTDFTLTISSLQPEDFATYYCQQGFSTPFTFGPGTKLEIK

SEQ ID NO: 2408 - protein, 107 aa, synthetic construct
DIQMTQSPSSLSASVGDRVTITCRASQSISSYLNWYQQKPGKAPKFLIYGASRLQSGVPSRFSGSGSGTDFTLTISSLQPEDFATYHCQQGSSPPFTFGPGTKLEIK

SEQ ID NO: 2409 - protein, 107 aa, synthetic construct; identical to SEQ ID NO: 2408

SEQ ID NO: 2410 - protein, 107 aa, synthetic construct
DIVMTQSPSSLSASVGDRVTITCRASQSISSYLNWYQQKPGKAPNFLIYGASRLQSGVPSRFSGSGSGTDFTLTISSLQPEDFATYYCQQGYSSPFTFGPGTKVDIK

SEQ ID NO: 2411 - protein, 107 aa, synthetic construct; identical to SEQ ID NO: 2410

SEQ ID NO: 2412 - protein, 107 aa, synthetic construct
DIQMTQSPSSLSASVGDRVTITCRASQSISRYLNWYQQKPGKAPKILIYGASSVQSGVPSRFSGSGSGTDFTLAISSLQPEDFATYYCQQGDSSPFTFGPGTKLEIK

SEQ ID NO: 2413 - protein, 107 aa, synthetic construct; identical to SEQ ID NO: 2412

SEQ ID NO: 2414 - protein, 107 aa, synthetic construct
DIVLTQSPSSLSASVGDRVTITCRASQSISSYLNWYQQKPGKAPKFLIYGASRLQSGVPSRFSGSGSGTDFTLTISSLQPEDFVTYYCQQGHSTPFTFGPGTKVDIK

SEQ ID NO: 2415 - protein, 107 aa, synthetic construct
DIQMTQSPSSLSASVGDRVTITCRASQSISSYLNWYQQSPGKAPKILIYGASRLQSGVPSRFSGSGSGTDFTLAISSLQPEDFATYYCQQGDSTPFTFGPGTKVEIK

SEQ ID NO: 2416 - protein, 107 aa, synthetic construct; identical to SEQ ID NO: 2415

SEQ ID NO: 2417 - protein, 107 aa, synthetic construct
DIVMTQSPSSLSASVGDRVTITCRASQSISSYLNWYQQKPGKAPKFLIYGASRLQSGVPSRFSGSGSGTDFTLTISSLQPEDFATYSCQQGYSSPFTFGPGTKVDIK

SEQ ID NO: 2418 - protein, 107 aa, synthetic construct; identical to SEQ ID NO: 2417

SEQ ID NO: 2419 - protein, 107 aa, synthetic construct
DIVMTQSPSSLSASVGDRVTITCRASQSISSYLNWYQQKPGKAPKFLIYGASSLQSGVPSRFSGSGSGTDFTLTISSLQPEDFATYYCQQGHSTPFTFGPGTKVDIK

SEQ ID NO: 2420 - protein, 107 aa, synthetic construct; identical to SEQ ID NO: 2419

SEQ ID NO: 2421 - protein, 107 aa, synthetic construct; identical to SEQ ID NO: 2393

SEQ ID NO: 2422 - protein, 107 aa, synthetic construct; identical to SEQ ID NO: 2393

SEQ ID NO: 2423 - protein, 107 aa, synthetic construct
DIVLTQSPSSLSASVGDRVTITCRASQSISSYLNWYQQKPGKAPKILIYGASSLQSGVPSRFSGSGSGTDFTLAISSLQPEDFATYYCQQGDSTPFTFGPGTKVDIK

SEQ ID NO: 2424 - protein, 107 aa, synthetic construct; identical to SEQ ID NO: 2423

SEQ ID NO: 2425 - protein, 107 aa, synthetic construct; identical to SEQ ID NO: 2423

SEQ ID NO: 2426 - protein, 107 aa, synthetic construct
DIVMTQSPSSLSASEGDRVTITCRASQSISSYLNWYQQKPGKAPKFLIYGASRLQSGVPSRFSGSGSGTDFTLTISSLQPEDFATYYCQQGYSSPFTFGPGTKVEIK

SEQ ID NO: 2427 - protein, 107 aa, synthetic construct; identical to SEQ ID NO: 2426

SEQ ID NO: 2428 - protein, 107 aa, synthetic construct
DIQMTQSPSSLSASVGDRVTITCRASQSISRYLNWYQQKPGKAPKILIYGASSVQSGVPSRFSGSGSGTDFTLAISSLQPEDFATYYCQQGDSSPFTFGPGTKVEIK

SEQ ID NO: 2429 - protein, 107 aa, synthetic construct; identical to SEQ ID NO: 2404

SEQ ID NO: 2430 - protein, 107 aa, synthetic construct; identical to SEQ ID NO: 2404

SEQ ID NO: 2431 - protein, 107 aa, synthetic construct
DIVMTQSPSSLSASVGDRVTITCRASQSISNYLNWYQQKPGKAPKFLIYGTSRLQSGVPSRFSGSGSGTDFTLTISSLQPEDFATYYCQQGYSSPFTFGPGTKVDIK

SEQ ID NO: 2432 - protein, 107 aa, synthetic construct; identical to SEQ ID NO: 2431

SEQ ID NO: 2433 - protein, 107 aa, synthetic construct
DIVMTQSPSSLSASVGDRVTITCRASQSISSYLNWYQQKPGKAPKFLIYGASRLQSGVPSRFSGSGSGTDFTLTISSLQPEDFATYYCQQGYSSPFTFGPGTKVDIK

SEQ ID NO: 2434 - protein, 107 aa, synthetic construct; identical to SEQ ID NO: 2433

SEQ ID NO: 2435 - protein, 107 aa, synthetic construct
DIVMTQSPSSLSASVGDRVTITCRASQSISSYLNWYQQSPGKAPKILIYGASRLQSGVPSRFSGSGSGTDFTLAISSLQPEDFATYYCQQGDNTPFTFGPGTKLEIK

SEQ ID NO: 2436 - protein, 107 aa, synthetic construct; identical to SEQ ID NO: 2435

SEQ ID NO: 2437 - protein, 107 aa, synthetic construct
DIVLTQSPSSLSASVGDRVTITCRASQSISSYLNWYQQKPGKAPKFLIYGASRLQSGVPSRFSGSGSGTDFTLTISSLQPEDFATYYCQQGHSTPFTFGPGTKVDIK

SEQ ID NO: 2438 - protein, 107 aa, synthetic construct; identical to SEQ ID NO: 2437

SEQ ID NO: 2439 - protein, 107 aa, synthetic construct
DIVMTQSPSSLSASVGDRVTITCRASQSISSYLNWYQQQPGKAPKFLIYGASRLQSGVPSRFSGSGSGTDFTLTINSLQPEDFATYFCQQGYSSPFTFGPGTKVEIK

SEQ ID NO: 2440 - protein, 107 aa, synthetic construct; identical to SEQ ID NO: 2439

SEQ ID NO: 2441 - protein, 107 aa, synthetic construct
DIVLTQSPASLSASVGDRVAITCRASQSISSYLNWYQQKPGKAPKFLIYGASSLQSGVPSRFSGSGSGTDFTLTISSLQPEDFATYYCQQGHSTPFTFGPGTKLEIK

SEQ ID NO: 2442 - protein, 107 aa, synthetic construct; identical to SEQ ID NO: 2441

SEQ ID NO: 2443 - protein, 107 aa, synthetic construct
DIVMTQSPSSLSASVGDRVTITCRASQTISSYLNWYQQKPGKAPKILIYGASSLQSGVPSRFSGSGSGTDFTLAISSLQPEDFATYYCQQGDSTPFTFGPGTKVDIK

SEQ ID NO: 2444 - protein, 107 aa, synthetic construct; identical to SEQ ID NO: 2443

SEQ ID NO: 2445 - protein, 107 aa, synthetic construct
DIVLTQSPSSLSASVGDRVTITCRASQSISKYLIWYQQKPGKAPNLLIYGASSLQSGVPSRFSGSGSGTDFTLTISSLQPEDFATYYCQQGHSTPFTFGPGTKVDIK

SEQ ID NO: 2446 - protein, 107 aa, synthetic construct; identical to SEQ ID NO: 2445

SEQ ID NO: 2447 - protein, 107 aa, synthetic construct
DIQLTQSPSSLSASVGDRVTITCRASQSISSYLNWYQQSPGKAPKILIYGASRLQSGVPSRFSGSGSGTDFTLAISSLQPEDFATYYCQQGDSTPFTFGPGTKVDIK

SEQ ID NO: 2448 - protein, 107 aa, synthetic construct; identical to SEQ ID NO: 2447

SEQ ID NO: 2449 - protein, 107 aa, synthetic construct; identical to SEQ ID NO: 2433

SEQ ID NO: 2450 - protein, 107 aa, synthetic construct; identical to SEQ ID NO: 2433

SEQ ID NO: 2451 - protein, 107 aa, synthetic construct
DIVLTQSPSSLSASVGDRVTITCRASLSISSYLNWYQQKPGKAPKLLIYGASSLQSGVPSRFSGSGSGTDFTLTISSLQPEDFATYYCQQGHSTPFTFGPGTKLEIK

SEQ ID NO: 2452 - protein, 107 aa, synthetic construct; identical to SEQ ID NO: 2451

SEQ ID NO: 2453 - protein, 107 aa, synthetic construct
DIQMTQSPSSLSASVGDRVTITCRASQSISSYLNWYQQKPGKAPKILIYGASSLQSGVPSRFSGSGSGTDFTLAISSLQPEDFATYYCQQGDSTPFTFGPGTKVEIK

SEQ ID NO: 2454 - protein, 107 aa, synthetic construct
DIQMTQSPSSLSASVGDRVTITCRSSQSISSYLNWYQQKPGKAPKILIYGASSLQSGVPSRFSGSGSGTDFTLAISSLQPEDFATYYCQQGDSTPFTFGPGTKVEIK

SEQ ID NO: 2455 - protein, 107 aa, synthetic construct; identical to SEQ ID NO: 2454

SEQ ID NO: 2456 - protein, 107 aa, synthetic construct
DIQMTQSPSSLSASVGDRVTITCRASRSISSYLNWYQQRPGKAPKFLIYGASRLQTGVPSRFSGSGSGTDFTLTISSLQPEDFATYYCQQGYSSPFTFGPGTKVDIK

SEQ ID NO: 2457 - protein, 107 aa, synthetic construct; identical to SEQ ID NO: 2456

SEQ ID NO: 2458 - protein, 107 aa, synthetic construct
DIQMTQSPSSLSASVGDRVTITCRASQSINSYLNWYQQKPGKAPKFLIYGASSLQSGVPSRFSGSGSGTDFTLTISSLQPEDFATYYCQQGYSTPFTFGPGTKVEIK

SEQ ID NO: 2459 - protein, 107 aa, synthetic construct
DIQMTQSPSSLSASVGDRVTITCRASQSIQSYLNWYQQKPGKAPKFLIYGASSLQSGVPSRFSGSGSGTDFTLTISSLQPEDFATYYCQQGYSTPFTFGPGTKVEIK

SEQ ID NO: 2460 - protein, 107 aa, synthetic construct
DIQMTQSPSTLSASVGDRVTITCRASQSISSYLNWYQQSPGKAPKILIYGASRLQSGVPSRFSGSGSGTDFTLAISSLQPEDFATYYCQQGDNTPFTFGPGTKVDIK

SEQ ID NO: 2461 - protein, 107 aa, synthetic construct; identical to SEQ ID NO: 2460

SEQ ID NO: 2462 - protein, 107 aa, synthetic construct
DIQMTQSPSSLSASVGDRVTITCRASQSINSYLYWYQQKPGKAPKLLIYGASSLQSGVPSRFSGSGSGTDFTLTISSLQPEDSATYYCQQGYSTPFTFGPGTKVEIK

SEQ ID NO: 2463 - protein, 107 aa, synthetic construct
DIQMTQSPSSLSASVGDRVTITCRASQSIQSYLYWYQQKPGKAPKLLIYGASSLQSGVPSRFSGSGSGTDFTLTISSLQPEDSATYYCQQGYSTPFTFGPGTKVEIK

SEQ ID NO: 2464 - protein, 107 aa, synthetic construct; identical to SEQ ID NO: 2393

SEQ ID NO: 2465 - protein, 107 aa, synthetic construct; identical to SEQ ID NO: 2393

SEQ ID NO: 2466 - protein, 107 aa, synthetic construct
DIVMTQSPSSLSASVGDRVTITCRASLSISSYLNWYQQKPGKAPKLLIYGASSLQSGVPSRFSGSGSGTDFTLTISSLQPEDFATYYCQQGHSTPFTFGPGTKLEIK

SEQ ID NO: 2467 - protein, 107 aa, synthetic construct; identical to SEQ ID NO: 2466

SEQ ID NO: 2468 - protein, 107 aa, synthetic construct
DIVMTQSPSSLSASVGDRVTITCRASQSISSYLNWYQQKPGKAPKFLIYGASRLQSGVPSRFSGSGSGTDFTLTISSLQPEDFATYFCQQGYSSPFTFGPGTKLEIK

SEQ ID NO: 2469 - protein, 107 aa, synthetic construct
EIVMTQSPASLSASVGDRVTITCRASQTISRYLNWYQQKPGKAPKFLIYGASSLQSGVPSRFSGSGSGTDFTLTISSLQPEDFATYYCQQSYSTPFTFGPGTKVDIK

SEQ ID NO: 2470 - protein, 107 aa, synthetic construct
EIVMTQSPASLSASVGDRVTITCRASQTISRYLNWYQQKPGKAPKFLIYGASSLQSGVPSRFSGSGSGTDFTLTISSLQPEDFATYYCQQGYSTPFTFGPGTKVDIK

SEQ ID NO: 2471 - protein, 107 aa, synthetic construct
DIQMTQSPSSLSASVGDRVTITCRASQSISSYLNWYQQSPGKAPKILIYGASRLQSGVPSRFRGSGSGTDFTLAISSLQPEDFATYYCQQGDSTPFTFGPGTKVDIK

SEQ ID NO: 2472 - protein, 107 aa, synthetic construct
DIVLTQSPSSLSASVGDRVTITCRASQSISSYLNWYQQKPGKAPKFLIYGASRLQSGVPSRFSGSGSGTDFTLTISSLQPEDFATYFCQQGYSSPFTFGPGTKLEIK

SEQ ID NO: 2473 - protein, 107 aa, synthetic construct
DIQMTQSPSSLSASVGDRVTITCRASQSISRYLNWYQQKPGKAPKILIYGASSVQSGVPSRFSGSGSGTDFTLAISSLQPEDFATYYCQQGDSSPFTFGPGTKVDIK

SEQ ID NO: 2474 - protein, 107 aa, synthetic construct
DIQMTQSPSSLSASVGDRVTITCRASQSISRYLNWYQQKPGKAPKILIYGASSLQSGVPSRFSGSGSGTDFTLTISSLQPEDFATYYCQQGYSTLFTFGPGTKLEIK

SEQ ID NO: 2475 - protein, 107 aa, synthetic construct
DIQMTQSPSSLSASVGDRVTITCRASQSISSYLNWYQQKPGKAPKFLIYGASRLQSGVPSRFSGSGSGTDFTLTISSLQPEDFATYYCQQGYSSPFTFGPGTKVDIK

SEQ ID NO: 2476 - protein, 107 aa, synthetic construct
DIQMTQSPSSLSASVGDRVTITCRASQSISSYLNWYQQKPGKAPKFLIYGASRLQSGVPSRFSGSGSGTDFTLTISSLQPEDFATYYCQQGYSNPFTFGPGTKVDIK

SEQ ID NO: 2477 - protein, 107 aa, synthetic construct
DIVMTQSPSSLSASVGDRVTITCRASQSISSYLNWYQQKPGKAPKLLIYGASRLQSGVPSRFSGSGSGTDFTLTISSLQPEDFATYYCQQGFSTPFTFGPGTKLEIK

SEQ ID NO: 2478 - protein, 107 aa, synthetic construct; identical to SEQ ID NO: 2475

SEQ ID NO: 2479 - protein, 107 aa, synthetic construct
DIVMTQSPSSLSASVGDRVTITCRASQSISRYLNWYQQKPGKAPNFLIYGASRLQSGVPSRFSGSGSGTDFTLTISSLQPEDFATYYCQQGYSSPFTFGPGTKVDIK

SEQ ID NO: 2480 - protein, 107 aa, synthetic construct; identical to SEQ ID NO: 2393

SEQ ID NO: 2481 - protein, 107 aa, synthetic construct
DIVMTQSPSSLSASVGDRVTITCRASQSISSFLNWYQQSPGKAPKILIYGASRLQSGVPSRFSGSGSGTDFTLAISSLQPEDFATYYCQQGDSTPFTFGPGTKVDIK

SEQ ID NO: 2482 - protein, 107 aa, synthetic construct
DIQMTQSPSSLSASVGDRVTITCRASQSISSYLNWYQQKPGKAPKFLIYGASSLQSGVPSRFSGSGSGTDFTLTISSLQPEDFATYYCQQGHSTPFTFGPGTKVDIK

SEQ ID NO: 2483 - protein, 107 aa, synthetic construct
DIVMTQSPSSLSASVGDRVTITCRASQSISSYLNWYQQKPGKAPKFLIYGASSLQSGVPSRFSGSGSGTDFTLTISSLQPEDFAAYYCQQGHSTPFTFGPGTKVDIK

SEQ ID NO: 2484 - protein, 107 aa, synthetic construct
DIVMTQSPSSLSASVGDRVTITCRASQSISSYLNWYQQKPGKAPKLLIYGASRLQSGVPSRFSGSGSGTDFTLTISSLQPEDFASYFCQQGHSTPITFGQGTKLEIK

SEQ ID NO: 2485 - protein, 107 aa, synthetic construct
DIQLTQSPSSLSASVGDRVTITCRASQSISSYLNWYQQKPGKAPKFLIYGASRLQSGVPSRFSGSGSGTDFTLTISSLQPEDFATYFCQQGYSSPFTFGPGTKVDIK

SEQ ID NO: 2486 - protein, 107 aa, synthetic construct
DIVLTQSPSSLSASVGDRVTITCRASQSISRYLYWYQQNPGKAPKLLIYAASSLQSGVPSRFSGSGSGTDFTLTISSLQPEDFATYYCQQGYDTPFTFGPGTKVDIK

SEQ ID NO: 2487 - protein, 107 aa, synthetic construct
DIQLTQSPSSLSASVGDRVTITCQASQDISNYLNWYQQKPGKAPKLLIYAASSLQTGVPSRFSGSGSGTDFTLAISSLQPEDFATYYCQQGDSTPFTFGPGTKLEIK

SEQ ID NO: 2488 - protein, 108 aa, synthetic construct
EIVLTQSPGTLSLSPGERATLSCRASQSVSDSYLAWYQQKPGQAPRLLIYGASSRATGIPDRFSGSGSGTDFTLTISRLEPEDFAVYYCQQYGTSPITFGQGTKLEIK

SEQ ID NO: 2489 - protein, 107 aa, synthetic construct
DIQMTQSPSSLSASVGDRVIITCRASQSISSYLNWYQQKPGKAPKLLIYGASSLQSGVPSRFSGSGAGTEFTLTISSLQPEDFATYYCQQAKSFPLTFGGGTKVEIK

SEQ ID NO: 2490 - protein, 107 aa, synthetic construct
DIVMTQSPSSLSASVGDRVTITCRASQSISSYLNWYQQKPGKAPKFLIYGASRLQSGVPSRFSGSGSGTDFTLTISSLQPEDFATYYCQQGYSSPFTFGGGTKVDIK

SEQ ID NO: 2491 - protein, 112 aa, synthetic construct
DIVMTQTPLSSPVPLGQPASISCKSSQSLVHSDGNTYLSWLQQRPGQPPRLLIYKISNRFSGVPDRFSGSGAGTDFTLKISRVEAEDVGVYYCMQVTQFPITLGQGTKLEIK

SEQ ID NO: 2492 - protein, 112 aa, synthetic construct
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPITLGQGTKLEIK

SEQ ID NO: 2493 - protein, 251 aa, Homo sapiens
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 2494 - protein, 192 aa, Homo sapiens
MQLTKGRLHFSHPLSHTKHISPFVTDAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 2495 - protein, 330 aa, synthetic construct [sequence omitted]

SEQ ID NO: 2496 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2497 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2498 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2499 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2500 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2501 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2502 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2503 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2504 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2505 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2506 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2507 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2508 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2509 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 2510 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 2511 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 2512 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 2513 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 2514 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 2515 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 2516 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 2517 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVDHHDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 2518 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVDHHDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 2519 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 2520 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 2521 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 2522 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 2523 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHAHYTQKSLSLSPGK

SEQ ID NO: 2524 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHAHYTQKSLSLSPGK

SEQ ID NO: 2525 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHAHYTQKSLSLSPGK

SEQ ID NO: 2526 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHAHYTQKSLSLSPGK

SEQ ID NO: 2527 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHAHYTQKSLSLSPGK

SEQ ID NO: 2528 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHAHYTQKSLSLSPGK

SEQ ID NO: 2529 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHAHYTQKSLSLSPGK

SEQ ID NO: 2530 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPGK

SEQ ID NO: 2531 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPGK

SEQ ID NO: 2532 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPGK

SEQ ID NO: 2533 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPGK

SEQ ID NO: 2534 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPGK

SEQ ID NO: 2535 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPGK

SEQ ID NO: 2536 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPGK

SEQ ID NO: 2537 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHWHYTQKSLSLSPGK

SEQ ID NO: 2538 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHWHYTQKSLSLSPGK

SEQ ID NO: 2539 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHWHYTQKSLSLSPGK

SEQ ID NO: 2540 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHWHYTQKSLSLSPGK

SEQ ID NO: 2541 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHWHYTQKSLSLSPGK

SEQ ID NO: 2542 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHWHYTQKSLSLSPGK

SEQ ID NO: 2543 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHWHYTQKSLSLSPGK

SEQ ID NO: 2544 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVDVSHEDPEVKFNWYVDGVEVHNAKTKPREEQYNSTYRVVSVLQVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2545 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVDVSHEDPEVKFNWYVDGVEVHNAKTKPREEQYASTYRVVSVLQVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2546 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVAVSHEDPEVKFNWYVDGVEVHNAKTKPREEQYNSTYRVVSVLQVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2547 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVHNAKTKPREEQYNSTYRVVSVLQVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2548 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRDPEVTCVVVDVSHEDPEVKFNWYVDGVEVHNAKTKPREEQYNSTYRVVSVLQVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2549 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRDPEVTCVVVDVSHEDPEVKFNWYVDGVEVHNAKTKPREEQYNSTYRVVSVLQVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2550 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVHNAKTKPREEQYNSTYRVVSVLQVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2551 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVDVSHEDPEVKFNWYVDGVEVHNAKTKPREEQYNSTYRVVSVLWVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2552 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVDVSHEDPEVKFNWYVDGVEVHNAKTKPREEQYASTYRVVSVLWVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2553 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVAVSHEDPEVKFNWYVDGVEVHNAKTKPREEQYNSTYRVVSVLWVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2554 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVHNAKTKPREEQYNSTYRVVSVLWVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2555 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRDPEVTCVVVDVSHEDPEVKFNWYVDGVEVHNAKTKPREEQYNSTYRVVSVLWVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2556 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRDPEVTCVVVDVSHEDPEVKFNWYVDGVEVHNAKTKPREEQYNSTYRVVSVLWVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2557 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVHNAKTKPREEQYNSTYRVVSVLWVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2558 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYISRDPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2559 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYISRDPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2560 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYISRDPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2561 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYISRDPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2562 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLYISRDPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2563 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLYISRDPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2564 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYISRDPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2565 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 2566 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 2567 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 2568 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 2569 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 2570 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 2571 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 2572 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVDVSHEDPEVKFNWYVDGVEVDNAKTKPREEQYNSTYRVVSVLRVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 2573 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVDVSHEDPEVKFNWYVDGVEVDNAKTKPREEQYASTYRVVSVLRVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 2574 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVAVSHEDPEVKFNWYVDGVEVDNAKTKPREEQYNSTYRVVSVLRVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 2575 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVDNAKTKPREEQYNSTYRVVSVLRVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 2576 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRDPEVTCVVVDVSHEDPEVKFNWYVDGVEVDNAKTKPREEQYNSTYRVVSVLRVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 2577 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRDPEVTCVVVDVSHEDPEVKFNWYVDGVEVDNAKTKPREEQYNSTYRVVSVLRVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 2578 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVDNAKTKPREEQYNSTYRVVSVLRVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 2579 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHRDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPGK

SEQ ID NO: 2580 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHRDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPGK

SEQ ID NO: 2581 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHRDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPGK

SEQ ID NO: 2582 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHRDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPGK

SEQ ID NO: 2583 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHRDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPGK

SEQ ID NO: 2584 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHRDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPGK

SEQ ID NO: 2585 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHRDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPGK

SEQ ID NO: 2586 - DNA, 1353 bp, synthetic construct
  source 1..1353: mol_type = other DNA
gaagtgcagctggtcgaatctggcggaggactcgtcaagccaggaggatccttgaggctctcctgtgccgccagcggattcacttttagcaatgcctggatgacctgggtgcgacaggctcccgggaaggggctcgagtgggtcggccgcatcaagtccaagatcgatgccggaactactgactatgctgcacctgtgaaaggtaggtttactatttctcgggacgatagtaagaacacattgtacctgcagatgaactctctgaagaccgaggacacagctgtatactattgcactacagacctcggttggggcgaaaactattggggacagggcacactcgttactgttagttcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggccgtcctacagtcctcaggactctactccctcagcagcgtggtgaccgtgccctccagcagcttgggcacccagacctacatctgcaacgtgaatcacaagcccagcaacaccaaggtggacaagaaggttgagcccaaatcttgtgacaaaactcacacatgcccaccgtgcccagcacctgaagccgctgggggaccgtcagtcttcctcttccccccaaaacccaaggacaccctctacatcacccgggagcctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggacgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggcaaataatag

SEQ ID NO: 2587 - DNA, 651 bp, synthetic construct
  source 1..651: mol_type = other DNA
gagaacgtgcttacacagtctccaggcacattgagcctctcacctggggagcgggccaccctctcatgccgggccagccagcgcgtctcttccagctatctggtgtggtaccagcagaagccaggacaggctcccagactgctgatctatggcgcctcctccagggctactggcattcctgaccgattcagcggctctgggagtggaacagattttacccttactatctcccgtctcgaacccgaagatttcgcagtgtactactgtcagcaatacggctctagtccctatacattcggacaagggactaaactggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaatag

SEQ ID NO: 2588 - DNA, 1350 bp, synthetic construct
  source 1..1350: mol_type = other DNA
caagtgcagctagtgcaatcaggtgccgaagttaaagaacctggagcctcagtcaaggtttcttgcaaggctagcggctacactttcactgcttattacatgcactgggtcagacaggccccaggtcaaggactggagtggatgggctggatcaacccaaagtctggaggcactaattacgcgcaacaatttcaagggcgggtgaccatgacccgcgacacctccatctccaccgcctacatggagctgagccggctgaccagtgacgatacagccgtgtactactgtgctgtcggtggctcttatgatgctttcgacatctggggccaggggactatggtaacagtcagttccgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggccgtcctacagtcctcaggactctactccctcagcagcgtggtgaccgtgccctccagcagcttgggcacccagacctacatctgcaacgtgaatcacaagcccagcaacaccaaggtggacaagaaggttgagcccaaatcttgtgacaaaactcacacatgcccaccgtgcccagcacctgaagccgctgggggaccgtcagtcttcctcttccccccaaaacccaaggacaccctctacatcacccgggagcctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggacgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggcaaataatag

SEQ ID NO: 2589 - DNA, 648 bp, synthetic construct
  source 1..648: mol_type = other DNA
gacattcagatgacccagtcaccctccagcttgtcagctagtgtcggtgaccgagtgaccataacctgtcgggctagccaatcaattagtagctacctcaattggtaccagcaaaagcccggcaaagcaccaaaattcctcatctatggagcaagcaggctacagtcaggcgtgccttcacgctttagtggcagcgggagcggcacagacttcaccctgtctatctcgtcactacaacctgaagacttcgccacctattattgtcaacaaggccactccacaccattcactttcgggccaggcaccaagctggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaatag

SEQ ID NO: 2590 - DNA, 1350 bp, synthetic construct
  source 1..1350: mol_type = other DNA
gaggtccagctcgttcaatcgggcgccgaagttaagaaacccggagcttctgtgaaagtgtcttgcaaagctagtggttatacattcaccgcctactacattcactgggttaggcaggccccaggccaggggctggagtggatgggatgggtcaaccctaagtctggtggtacaaattacgcccaatccttccaagggagagtgaccatgaccggcgatacttccatcaccacggcatacatggacttgagcgagctcaggagcgacgacactgctgtgtactactgcgccgttggcggatccttcgacgcttttgatatctggggccagggcaccatggtgacggtctcttctgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggccgtcctacagtcctcaggactctactccctcagcagcgtggtgaccgtgccctccagcagcttgggcacccagacctacatctgcaacgtgaatcacaagcccagcaacaccaaggtggacaagaaggttgagcccaaatcttgtgacaaaactcacacatgcccaccgtgcccagcacctgaagccgctgggggaccgtcagtcttcctcttccccccaaaacccaaggacaccctctacatcacccgggagcctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggacgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggcaaataatag

SEQ ID NO: 2591 - DNA, 648 bp, synthetic construct
  source 1..648: mol_type = other DNA
gatattgtcatgacccagtctccatcatcactgagtgcttctgtcggagatagagtcacaatcacatgtcgtgcaagccaatctatctcttcatacctgaactggtaccaacaaaaacctgggaaggctccaaagttcctcatttatggcgccagctccctccaaagcggggtaccttcgaggttcagcggcagtggctctggcaccgactttacactcaccattagttccttgcaaccggaggattttgcaacctactattgtcaacaaggccatagtactccctttacatttggccccggaacaaaagtagacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaatag

SEQ ID NO: 2592 - DNA, 1350 bp, synthetic construct
  source 1..1350: mol_type = other DNA
gaagtgcagttggtacaaagtggcgccgaggttaagaagcctggggcctccgtgaaggtgtcttgtaaagcctctggatacaccttcactggttactatatgcactgggtccggcaagctccgggacagggtctggagtggatgggctggatcaatccaaaatcaggaggaaccaactatgcacaaaaattccagggcagagtcaccatgacccgggatacaagtatttcaaccgcgtacatggagctgagcaggctaatatcggacgacaccgctgtctactactgcgccactgggggcagcttcgatgctttcgatgtctggggacagggcactatggtgacagtgtctagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggccgtcctacagtcctcaggactctactccctcagcagcgtggtgaccgtgccctccagcagcttgggcacccagacctacatctgcaacgtgaatcacaagcccagcaacaccaaggtggacaagaaggttgagcccaaatcttgtgacaaaactcacacatgcccaccgtgcccagcacctgaagccgctgggggaccgtcagtcttcctcttccccccaaaacccaaggacaccctctacatcacccgggagcctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggacgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggcaaataatag

SEQ ID NO: 2593 - DNA, 648 bp, synthetic construct
  source 1..648: mol_type = other DNA
gacatcgtgatgacacaaagcccttcttctctgagtgcatccgttggagaccgcgtgactatcacctgccgggccagccagagcatctcttcatatttgaactggtaccaacaatctcctggcaaggcaccaaagatcctcatatatggagcaagtagactgcaatcaggcgttcctagccgattttccggaagcggatcagggaccgactttacattggctatttcaagcctgcaacccgaagatttcgctacctattattgtcaacaaggcgacaacactccctttaccttcggaccagggaccaagttggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaatag

SEQ ID NO: 2594 - DNA, 1350 bp, synthetic construct
  source 1..1350: mol_type = other DNA
caggtgcagctcgttcaatctggagcagaagttaagcggccaggcgcctctgtaaaagtgtcttgcaaggccagcggatacacctttaccgcttactacttgcactgggtcaggcaggcaccgggccagggcctggaatggatgggatggatcaaccctaagagtggtggcaccaattatgcccaaaaatttcaggatcgagtcacaatgaccggggacacttctattagcactgcatatatggagctcagccgcctgagatccgatgacacagccgtgtactactgtgctgttggcggtagttatgacgccttcgacatctggggccagggcaccatggtgactgtgtcatcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggccgtcctacagtcctcaggactctactccctcagcagcgtggtgaccgtgccctccagcagcttgggcacccagacctacatctgcaacgtgaatcacaagcccagcaacaccaaggtggacaagaaggttgagcccaaatcttgtgacaaaactcacacatgcccaccgtgcccagcacctgaagccgctgggggaccgtcagtcttcctcttccccccaaaacccaaggacaccctctacatcacccgggagcctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggacgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggcaaataatag

SEQ ID NO: 2595 - DNA, 648 bp, synthetic construct
  source 1..648: mol_type = other DNA
gacatccagatgacccagagcccatcaagtctcagcgccagtgtcggggacagagtgactataacttgtcgcgctagtcagtccattcaatcctatctgaactggtaccagcaaaagcccggcaaggcaccaaaattcctcatttatggtgctagttctctacaatctggcgtcccgtcccggttctccggaagcggcagcggcaccgattttactctgaccatctcttctctgcaaccagaagacttcgctacttattactgccaacaaggctactctacacctttcacttttggaccaggcaccaaggttgagattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaatag

The invention claimed is:

1. A TL1A binding protein, comprising:

a heavy chain variable region (VH) comprising (i) a CDR1 having an amino acid sequence according to SEQ ID NO: 5, (ii) a CDR2 having an amino acid sequence according to SEQ ID NO: 15, and (iii) a CDR3 having an amino acid sequence according to SEQ ID NO: 25; and a light chain variable region (VL) comprising (i) a CDR1 having an amino acid sequence according to SEQ ID NO: 35, (ii) a CDR2 having an amino acid sequence according to SEQ ID NO: 45, and (iii) a CDR3 having an amino acid sequence according to SEQ ID NO: 55; or a heavy chain variable region (VH) comprising (i) a CDR1 having an amino acid sequence according to SEQ ID NO: 6, (ii) a CDR2 having an amino acid sequence according to SEQ ID NO: 16, and (iii) a CDR3 having an amino acid sequence according to SEQ ID NO: 26; and a light chain variable region (VL) comprising (i) a CDR1 having an amino acid sequence according to SEQ ID NO: 36, (ii) a CDR2 having an amino acid sequence according to SEQ ID NO: 46, and (iii) a CDR3 having an amino acid sequence according to SEQ ID NO: 56; or a heavy chain variable region (VH) comprising (i) a CDR1 having an amino acid sequence according to SEQ ID NO: 7, (ii) a CDR2 having an amino acid sequence according to SEQ ID NO: 17, and (iii) a CDR3 having an amino acid sequence according to SEQ ID NO: 27; and a light chain variable region (VL) comprising (i) a CDR1 having an amino acid sequence according to SEQ ID NO: 37, (ii) a CDR2 having an amino acid sequence according to SEQ ID NO: 47, and (iii) a CDR3 having an amino acid sequence according to SEQ ID NO: 57; or a heavy chain variable region (VH) comprising (i) a CDR1 having an amino acid sequence according to SEQ ID NO: 8, (ii) a CDR2 having an amino acid sequence according to SEQ ID NO: 18, and (iii) a CDR3 having an amino acid sequence according to SEQ ID NO: 28; and a light chain variable region (VL) comprising (i) a CDR1 having an amino acid sequence according to SEQ ID NO: 38, (ii) a CDR2 having an amino acid sequence according to SEQ ID NO: 48, and (iii) a CDR3 having an amino acid sequence according to SEQ ID NO: 58; or a heavy chain variable region (VH) comprising (i) a CDR1 having an amino acid sequence according to SEQ ID NO: 9, (ii) a CDR2 having an amino acid sequence according to SEQ ID NO: 19, and (iii) a CDR3 having an amino acid sequence according to SEQ ID NO: 29; and a light chain variable region (VL) comprising (i) a CDR1 having an amino acid sequence according to SEQ ID NO: 39, (ii) a CDR2 having an amino acid sequence according to SEQ ID NO: 49, and (iii) a CDR3 having an amino acid sequence according to SEQ ID NO: 59; or a heavy chain variable region (VH) comprising (i) a CDR1 having an amino acid sequence according to SEQ ID NO: 10, (ii) a CDR2 having an amino acid sequence according to SEQ ID NO: 20, and (iii) a CDR3 having an amino acid sequence according to SEQ ID NO: 30; and a light chain variable region (VL) comprising (i) a CDR1 having an amino acid sequence according to SEQ ID NO: 40, (ii) a CDR2 having an amino acid sequence according to SEQ ID NO: 50, and (iii) a CDR3 having an amino acid sequence according to SEQ ID NO: 60.

2. The TL1A binding protein of claim 1, wherein the VH comprises a sequence having at least 80% sequence identity to the amino acid sequence of SEQ ID NO: 185 and the VL comprises a sequence having at least 80% sequence identity to the amino acid sequence of SEQ ID NO: 195, the VH comprises a sequence having at least 80% sequence identity to the amino acid sequence of SEQ ID NO: 186 and the VL comprises a sequence having at least 80% sequence identity to the amino acid sequence of SEQ ID NO: 196, the VH comprises a sequence having at least 80% sequence identity to the amino acid sequence of SEQ ID NO: 187 and the VL comprises a sequence having at least 80% sequence identity to the amino acid sequence of SEQ ID NO: 197, the VH comprises a sequence having at least 80% sequence identity to the amino acid sequence of SEQ ID NO: 188 and the VL comprises a sequence having at least 80% sequence identity to the amino acid sequence of SEQ ID NO: 198, the VH comprises a sequence having at least 80% sequence identity to the amino acid sequence of SEQ ID NO: 189 and the VL comprises a sequence having at least 80% sequence identity to the amino acid sequence of SEQ ID NO: 199, or wherein the VH comprises a sequence having at least 80% sequence identity to the amino acid sequence of SEQ ID NO: 190 and the VL comprises a sequence having at least 80% sequence identity to the amino acid sequence of SEQ ID NO: 200.

3. The TL1A binding protein of claim 1, wherein the TL1A binding protein is an antibody having IgG1, IgG2 or IgG4 immunoglobulin Fc domain.

4. The TL1A binding protein of claim 3, wherein the Fc domain is a modified Fc that extends half-life of the TL1A binding protein as compared to a TL1A binding protein that does not comprise the modified Fc domain.

5. The TL1A binding protein of claim 3, wherein the Fc domain is an IgG1 Fc domain and comprises amino acid modifications L234A/L235A (LALA) and/or M252Y, S254T, and T256E (YTE) according to Kabat numbering.

6. An injectable liquid composition comprising the TL1A binding protein of claim 1 and a pharmaceutically acceptable carrier.

7. A TL1A binding protein, comprising:

a heavy chain variable region (VH) comprising (i) a CDR1 having an amino acid sequence according to SEQ ID NO: 9, (ii) a CDR2 having an amino acid sequence according to SEQ ID NO: 19, and (iii) a CDR3 having an amino acid sequence according to SEQ ID NO: 29; and a light chain variable region (VL) comprising (i) a CDR1 having an amino acid sequence according to SEQ ID NO: 39, (ii) a CDR2 having an amino acid sequence according to SEQ ID NO: 49, and (iii) a CDR3 having an amino acid sequence according to SEQ ID NO: 59.

8. A TL1A binding protein, comprising:

a heavy chain variable region (VH) comprising (i) a CDR1 having an amino acid sequence according to SEQ ID NO: 10, (ii) a CDR2 having an amino acid sequence according to SEQ ID NO: 20, and (iii) a CDR3 having an amino acid sequence according to SEQ ID NO: 30; and a light chain variable region (VL) comprising (i) a CDR1 having an amino acid sequence according to SEQ ID NO: 40, (ii) a CDR2 having an amino acid sequence according to SEQ ID NO: 50, and (iii) a CDR3 having an amino acid sequence according to SEQ ID NO: 60.

9. The TL1A binding protein of claim 8, wherein the VH comprises a sequence having at least 80% sequence identity to the amino acid sequence of SEQ ID NO: 190 and the VL comprises a sequence having at least 80% sequence identity to the amino acid sequence of SEQ ID NO: 200.

10. The TL1A binding protein of claim 8, wherein the VH comprises the amino acid sequence of SEQ ID NO: 190 and the VL comprises the amino acid sequence of SEQ ID NO: 200.

11. A TL1A binding protein, comprising:

a heavy chain variable region (VH) comprising (i) a CDR1 having an amino acid sequence according to SEQ ID NO: 5, (ii) a CDR2 having an amino acid sequence according to SEQ ID NO: 15, and (iii) a CDR3 having an amino acid sequence according to SEQ ID NO: 25; and a light chain variable region (VL) comprising (i) a CDR1 having an amino acid sequence according to SEQ ID NO: 35, (ii) a CDR2 having an amino acid sequence according to SEQ ID NO: 45, and (iii) a CDR3 having an amino acid sequence according to SEQ ID NO: 55; or a heavy chain variable region (VH) comprising (i) a CDR1 having an amino acid sequence according to SEQ ID NO: 6, (ii) a CDR2 having an amino acid sequence according to SEQ ID NO: 16, and (iii) a CDR3 having an amino acid sequence according to SEQ ID NO: 26; and a light chain variable region (VL) comprising (i) a CDR1 having an amino acid sequence according to SEQ ID NO: 36, (ii) a CDR2 having an amino acid sequence according to SEQ ID NO: 46, and (iii) a CDR3 having an amino acid sequence according to SEQ ID NO: 56; or a heavy chain variable region (VH) comprising (i) a CDR1 having an amino acid sequence according to SEQ ID NO: 7, (ii) a CDR2 having an amino acid sequence according to SEQ ID NO: 17, and (iii) a CDR3 having an amino acid sequence according to SEQ ID NO: 27; and a light chain variable region (VL) comprising (i) a CDR1 having an amino acid sequence according to SEQ ID NO: 37, (ii) a CDR2 having an amino acid sequence according to SEQ ID NO: 47, and (iii) a CDR3 having an amino acid sequence according to SEQ ID NO: 57; or a heavy chain variable region (VH) comprising (i) a CDR1 having an amino acid sequence according to SEQ ID NO: 8, (ii) a CDR2 having an amino acid sequence according to SEQ ID NO: 18, and (iii) a CDR3 having an amino acid sequence according to SEQ ID NO: 28; and a light chain variable region (VL) comprising (i) a CDR1 having an amino acid sequence according to SEQ ID NO: 38, (ii) a CDR2 having an amino acid sequence according to SEQ ID NO: 48, and (iii) a CDR3 having an amino acid sequence according to SEQ ID NO: 58.

* * * * *